(12) United States Patent
Yang et al.

(10) Patent No.: US 11,129,905 B2
(45) Date of Patent: Sep. 28, 2021

(54) BIVALENT, BISPECIFIC BINDING PROTEINS FOR PREVENTION OR TREATMENT OF HIV INFECTION

(71) Applicant: Sanofi, Paris (FR)

(72) Inventors: Zhi-Yong Yang, Bridgewater, NJ (US); Gary J. Nabel, Bridgewater, NJ (US); Ling Xu, Bridgewater, NJ (US); Jochen Beninga, Frankfurt am Main (DE); Jochen Kruip, Erzhausen (DE); Ercole Rao, Morfelden-Walldorf (DE); Wulf Dirk Leuschner, Frankfurt am Main (DE); Christian Beil, Frankfurt am Main (DE); Christian Lange, Frankfurt am Main (DE)

(73) Assignee: SANOFI, Paris (FR)

( * ) Notice: Subject to any disclaimer, the term of this patent is extended or adjusted under 35 U.S.C. 154(b) by 0 days.

(21) Appl. No.: 16/659,426

(22) Filed: Oct. 21, 2019

(65) Prior Publication Data

US 2020/0054765 A1 Feb. 20, 2020

Related U.S. Application Data

(63) Continuation of application No. 15/770,471, filed as application No. PCT/US2016/058540 on Oct. 24, 2016, now abandoned.

(60) Provisional application No. 62/246,113, filed on Oct. 25, 2015, provisional application No. 62/322,029, filed on Apr. 13, 2016, provisional application No. 62/331,169, filed on May 3, 2016.

(30) Foreign Application Priority Data

Feb. 24, 2016 (EP) .................... 16305211

(51) Int. Cl.
| | |
|---|---|
| *C07K 16/28* | (2006.01) |
| *A61K 39/00* | (2006.01) |
| *C07K 14/705* | (2006.01) |
| *C07K 14/725* | (2006.01) |
| *C12N 15/86* | (2006.01) |
| *A61K 47/68* | (2017.01) |
| *C07K 16/10* | (2006.01) |
| *C07K 16/46* | (2006.01) |
| *A61P 31/18* | (2006.01) |
| *A61K 39/42* | (2006.01) |

(52) U.S. Cl.
CPC .......... *A61K 47/6881* (2017.08); *A61P 31/18* (2018.01); *C07K 16/1063* (2013.01); *C07K 16/468* (2013.01); *A61K 39/42* (2013.01); *C07K 2317/31* (2013.01); *C07K 2317/565* (2013.01); *C07K 2317/76* (2013.01); *C07K 2317/92* (2013.01); *C07K 2317/94* (2013.01)

(58) Field of Classification Search
CPC ........ C12Q 2563/156; C12Q 2563/179; C12Q 1/6804; C12Q 1/6869; C07K 14/7051
See application file for complete search history.

(56) References Cited

U.S. PATENT DOCUMENTS

| | | | |
|---|---|---|---|
| 9,181,349 B2 | 11/2015 | Baurin | |
| 9,221,917 B2 | 12/2015 | Baurin | |
| 10,882,922 B2 | 1/2021 | Yang | |
| 2010/0226923 A1 | 9/2010 | Rao | |
| 2012/0076782 A1 | 3/2012 | Tesar | |
| 2012/0201827 A1 | 8/2012 | Elias | |
| 2012/0251541 A1 | 10/2012 | Baurin | |
| 2013/0345404 A1 | 12/2013 | Baurin | |
| 2014/0213772 A1 | 7/2014 | Ghayur | |
| 2014/0322217 A1 | 10/2014 | Moore | |
| 2016/0200811 A1 | 7/2016 | Baurin | |
| 2017/0320967 A1 | 11/2017 | Yang | |
| 2018/0237511 A1 | 8/2018 | Beil | |
| 2019/0054182 A1 | 2/2019 | Yang | |
| 2019/0106504 A1 | 4/2019 | Wu | |
| 2020/0140552 A1 | 5/2020 | Wu | |
| 2020/0385470 A1 | 12/2020 | Bacac et al. | |
| 2021/0061925 A1 | 3/2021 | Yang et al. | |

FOREIGN PATENT DOCUMENTS

| | | |
|---|---|---|
| CN | 104968685 A | 10/2015 |
| CN | 105837688 A | 8/2016 |
| EP | 0308936 A2 | 2/1989 |
| EP | 1378520 A1 | 1/2004 |
| EP | 1736484 A1 | 12/2006 |
| TW | 201437227 A | 10/2014 |
| WO | WO199627011 A1 | 9/1996 |
| WO | WO199951642 A1 | 10/1999 |
| WO | WO2005000899 A2 | 1/2005 |
| WO | WO2009149189 A2 | 12/2009 |
| WO | WO2011038290 A2 | 3/2011 |
| WO | WO2011154453 A1 | 12/2011 |
| WO | 2012065055 A3 | 7/2012 |
| WO | WO2012092612 A1 | 7/2012 |
| WO | WO2012135345 A1 | 10/2012 |
| WO | WO2012154312 A1 | 11/2012 |

(Continued)

OTHER PUBLICATIONS

Alegre, M. et al. (Jun. 1994). "A Non-Activating "Humanized" Anti-CD3 Monoclonal Antibody Retains Immunosuppressive Properties in Vivo," Transplantation, 57(11):1537-1543.

Almeida, J. et al. (1999). "High-Sensitive Immunophenotyping and DNA Ploidy Studies for the Investigation of Minimal Residual Disease in Multiple Myeloma," British J of Haematol. 107:121-131.

Altschul, S.F.et al. (1997). "Gapped Blast and PSI-Blast: A New Generation of Protein Database Search Programs," Nucleic Acids Res. 25(17):3389-3402.

(Continued)

Primary Examiner — Barry A Chestnut
(74) Attorney, Agent, or Firm — Morrison & Foerster LLP

(57) ABSTRACT

Provided herein are bivalent, bispecific binding proteins that specifically bind to two different HIV-1 Env protein epitopes.

3 Claims, 20 Drawing Sheets

Specification includes a Sequence Listing.

(56) References Cited

FOREIGN PATENT DOCUMENTS

| WO | WO2012158948 A1 | 11/2012 |
|---|---|---|
| WO | WO2013070776 A1 | 5/2013 |
| WO | WO2013086533 A1 | 6/2013 |
| WO | WO2013163427 A1 | 10/2013 |
| WO | 2014093894 A2 | 6/2014 |
| WO | WO2014089152 A1 | 6/2014 |
| WO | 2014093894 A3 | 7/2014 |
| WO | WO2014116846 A2 | 7/2014 |
| WO | WO2014144299 A2 | 9/2014 |
| WO | 2015017755 A1 | 2/2015 |
| WO | WO2015063339 A1 | 5/2015 |
| WO | WO2015149077 A1 | 10/2015 |
| WO | WO2016033690 A1 | 3/2016 |
| WO | WO2016116626 A1 | 7/2016 |
| WO | WO2016196740 A1 | 12/2016 |
| WO | WO2017074878 A1 | 5/2017 |
| WO | WO2017106346 A2 | 6/2017 |
| WO | WO2017180913 A2 | 10/2017 |
| WO | WO2017180913 A3 | 2/2018 |
| WO | WO2018120842 A1 | 7/2018 |
| WO | WO2018151841 A1 | 8/2018 |
| WO | 2018183294 A1 | 10/2018 |
| WO | WO2017053556 A1 | 12/2018 |

OTHER PUBLICATIONS

Atwell, S. et al. (1997). "Stable Heterodimers From Remodeling the Domain Interface of a Homodimer Using a Phage Display Library," J. Mol. Biol. 270 (1):26-35.

Brandsma, A.M. et al. (Oct. 1, 2017; e-pub. Aug. 16, 2017). "Single Nucleotide Polymorphisms of the High Affinity IgG Receptor FcβRl Reduce Immune Complex Binding and Downstream Effector Functions," The Journal of Immunology 199(7):2432-2439.

Chai, J.G. et al. (1997). "Immobilized Anti-CD3 mAb Induces Anergy in Murine Naive and Memory CD4+ T Cells," Int Immunol. 9(7):935-944.

Chen, H.W. et al. (Apr. 1, 2006). "Ex Vivo Expansion of Dendritic-Cell-Activated Antigenspecific CD41\+ T Cells With Anti-CD3/CD28, Interleukin-? and Interleukin-15: Potential for Adoptive T Cell Immunotherapy," Clinical Immunology 119(1):21-31.

Chothia, C. et al. (Aug. 20, 1987). "Canonical Structures for the Hypervariable Regions of Immunoglobulins," J. Biol. 196(4):901-917. Mol.

Chothia, C. et al. (Dec. 21-28, 1989). "Conformations of Immunoglobulin Hypervariable Regions," Nature 342 (6252):877-883.

Chu, S.Y et al. (Dec. 4, 2014). "Immunotherapy with Long-Lived Anti-CD38 x Anti-CD3 Bispecific Antibodies Stimulates Potent T Cell-Mediated Killing of Human Myeloma Cell Lines and CD38+ Cells in Monkeys: A Potential Therapy for Multiple Myeloma," Blood 124(21): 4727, 6 pages.

Colombian Opposition dated Mar. 15, 2019 for CO Application No. NC2018/0012107 filed on Nov. 9, 2018, twenty-one pages.

Deckert, J. et al. (2014; e-pub. Jul. 1, 2014). "SAR650984, a Novel Humanized CD38-Targeting Antibody, Demonstrates Potent Anti-Tumor Activity in Models of Multiple Myeloma and Other CD38+ Hematologic Malignancies," Clin. Cancer Res 20:4574-4583.

Digiammarino, E. et al. (Sep.-Oct. 2011, e-pub. Sep. 1, 2011). "Ligand Association Rates to the Inner-Variable-Domain of a Dual-Variable-Domain Immunoglobulin are Significantly Impacted by Linker Design," MAbs. 3(5):487-494.

EBI Accession No. GSP: BAH64671 Sequence (Jan. 13, 2013). "Anti-HIV Human Antibody Variable Light Chain (VL), VRCO1," one page.

EBI Accession No. GSP: BAO38135 Sequence (Jul. 4, 2013). "Human Germline 10E8 Antibody Heavy Chain Revertant Seq ID N0:149," one page.

Esensten, J.H. et al. (May 17, 2016). "CD28 Costimulation: From Mechanism to Therapy," Immunity 44:973-988.

Findlay, L. et al. (2010; e-pub. Nov. 4, 2009). "Improved in Vitro Methods to Predict the in Vivo Toxicity in Man of Therapeutic Monoclonal Antibodies Including TGN1412," J Immunol Methods 352:1-12.

Fournier, P. et al. (Jan. 2010). "Tumor Antigen-Dependent and Tumor Antigen-Independent Activation of Antitumor Activity in T Cells by a Bispecific Antibody-Modified Tumor Vaccine," Clinical & Developmental Immunology 2010(1):Article IDs 423781, 12 pages.

Garfall, A.L. et al. (Nov. 21, 2019). "Three is a Charm for anAntibody to Fight Cancer," Nature 575:450-451.

Gratama, J,W. et al. (Sep. 1, 2001). "Tetramer-Based Quantification of Cytomegalovirus (CMV)—Specific CD81 T Lymphocytes in T-Cell—Depleted Stem Cell Grafts and After Transplantation May Identify Patients at Risk for Progressive CMV Infection," Blood 98(5):1358-1364.

Haas, C. et al. (Mar. 31, 2005; e-pub. Nov. 25, 2004). "T-cell Triggering by CD3- and CD28-Binding Molecules Linked to a Human Virus-Modified Tumor Cell Vaccine," Vaccine 23(19):2439-2453.

Hartman, W.R. et al. (May 17, 2010). "CD38 Expression, Function, and Gene Resequencing in a Human Lymphoblastoid Cell Line-Based Model System," Leukemia and Lymphoma 51(7):1315-1325.

Hinton, P.R. et al. (Jan. 1, 2006). "An Engineered Human IgG1 Antibody With Longer Serum Half-Life," J. Immunol. 176(1):346-356.

Hitoshi, N. et al. (Dec. 15, 1991). "Efficient Selection for High-Expression Transfectants with a Novel Eukaryotic Vector," Gene 108(2):193-199.

Hui, E. et al. (Mar. 31, 2017). "T Cell Costimulatory Receptor CD28 is a Primary Target for PD-1-Mediated Inhibition," Science 355(6332):1428-1433, 13 pages.

International Preliminary Report on Patentability dated May 11, 2018 for PCT Application No. PCT/US2016/058540 filed on Oct. 24, 2016, seven pages.

International Preliminary Report on Patentability dated Oct. 25, 2018 for PCT Application No. PCT/US2017/027488, filed on Apr. 13, 2017, thirty one pages.

International Search Report and Written Opinion dated Jan. 2, 2018 for PCT Application No. PCT/ US2017/027488, filed on Apr. 13, 2017, forty four pages.

International Search Report and Written Opinion of the International Searching Authority dated Mar. 10, 2017 for PCT Application No. PCT/US2016/058540 filed on Oct. 24, 2016, fifteen pages.

International Search Report dated Dec. 17, 2019, for PCT Application No. PCT/US2019/055232, filed on Oct. 8, 2019, seven pages.

International Search Report dated May 17, 2019, for PCT Application No. PCT/US2018/055084, filed on Oct. 9, 2018, twelve pages.

Invitation to Pay Additional Fees and, Where Applicable, Protest Fee dated Feb. 20, 2019, for PCT Application No. PCT/US2018/055084, filed on Oct. 9, 2018, twenty three pages.

Invitation to Pay Additional Fees and, Where Applicable, Protest Fee dated Oct. 16, 2017, for PCT Application No. PCT/US2017/027488, filed on Apr. 13, 2017, twenty eight pages.

Jakob, C.G. et al. (May 1, 2013, e-pub. Apr. 2, 2013). "Structure Reveals Function of the Dual Variable Domain Immunoglobulin (DVD-Ig™) Molecule," MAbs. 5(3):358-363.

Kalim, M. et al. (2017; e-pub. Aug. 2, 2017). "Intracellular Trafficking of New Anticancer Therapeutics: Antibody—Drug Conjugates," Drug Des. Devel. Ther. 11:2265-2276.

Kilpatrick, K.E. et al. (Aug. 1997). "Rapid Development of Affinity Matured Monoclonal Antibodies Using RIMMS," Hybridoma 16(4):381-389.

LeFranc, M.P. et al. (Jan. 2003). "IMGT Unique Numbering for Immunoglobulin and T Cell Receptor Variable Domains and Ig Superfamily V-Like Domains," Dev. Comp. Immunol. 27(1):55-77.

Li, T. et al. (Jun. 2, 2016). "Immuno-Targeting the Multifunctional CD38 Using Nanobody," Scientific Reports 6 (1):27055, 11 pages.

Liu, Q. et al. (Sep. 2005). "Crystal Structure of Human CD38 Extracellular Domain," Structure 13(9):1331-1339.

(56) References Cited

OTHER PUBLICATIONS

MacCallum, R.M. et al. (1996). "Antibody-Antigen Interactions: Contact Analysis and Binding Site Topography," J. Mol. Biol. 262:732-745.

Masui, S. et al. (Mar. 1, 2005). "An Efficient System to Establish Multiple Embryonic Stem Cell Lines Carrying an Inducible Expression Unit," Nucleic Acids Res. 33(4):e43, pp. 1-8.

Mateo, G. et al. (May 15, 2005). "Genetic Abnormalities and Patterns of Antigenic Expression in Multiple Myeloma," Clin. Cancer Res. 11(10):3661-3667.

McDermott, S.P. et al. (Jul. 15, 2010, e-published as Apr. 19, 2010). "Comparison of Human Cord Blood Engraftment Between Immunocompromised Mouse Strains," Blood 116(2):193-200.

McKeage, K. (Feb. 2016). "Daratumumab: First Global Approval," Drugs. 76(2):275-281.

Merchant, A. M. et al. (Jul. 1998). "An Efficient Route to Human Bispecific IgG," Nature Biotechnology 16:677-681.

Moore, G. et al. (Dec. 5, 2015). "1798 Tuning T Cell Affinity Improves Efficacy and Safety of Anti-CD38 x Anti-CD3 Bispecific Antibodies in Monkeys—a Potential Therapy for Multiple Myeloma," American Society of Hematology, Poster Abstract presented at 57th Annual Meeting & Exposition, Orlando, FL, three pages.

Morphosys. (Nov. 25, 2010). "R&D Day 2010," 102 pages (as cited in 299.41)—Rojkjaer, L. (Nov. 29, 2010). "Morphosys R&D 2010," URL:https://www.morphosys.de/sites/default/files/phoneconferences/downloads/101125mar_rd_nov_2010_nyc_final.pdf.

Nair, J.R. et al. (2011; e-pub. Jun. 29, 2011). "CD28 Expressed on Malignant Plasma Cells Induces a Prosurvival and Immunosuppressive Microenvironment," J Immunol. 187:1243-1253.

Padlan, E.A. et al. (Jan. 1995). "Identification of Specificity-Determining Residues in Antibodies," FASEB J. 9 (1):133-139.

Parslow, A.C. et al. (2016). "Antibody—Drug Conjugates for Cancer Therapy," Biomedicines 4:14, pp. 1-17.

Penaranda, C.I. et al. (Aug. 15, 2011). "Anti-CD3 Therapy Promotes Tolerance by Selectively Depleting Pathogenic Cells While Preserving Regulatory T Cells," J Immunol. 187(4):2015-2022.

Peters, B. et al. (Mar. 2005; e-pub. Mar. 15, 2005). "The Immune Epitope Database and Analysis Resource: From Vision to Blueprint," PLos Biol. 3(3):e91, pp. 0379-0381.

Ridgway, J.B.B. et al. (1996). "'Knobs-Into-Holes' Engineering of Antibody CH3 Domains for Heavy Chain Heterodimerization," Protein Engineering 9(7):617-621.

Robillard, N. et al. (Jun. 1998). "CD28, a Marker Associated with Tumoral Expansion in Multiple Myeloma," Clin Cancer Res. 4:1521-1526.

Rudikoff, S. et al. (Mar. 1982). "Single Amino Acid Substitution Altering Antigen-Binding Specificity," Proc. Natl. Acad. Sci. USA 79:1979-1983.

Sarzotti-Kelsoe, M. et al. (Jul. 2014; e-published on Dec. 1, 2013). "OOptimization and Validation of the TZM-BI Assay for Standardized Assessments of Neutralizing Antibodies Against HIV-1," J. Immunological Methods 409:131-146, 37 pages.

Sharma, P. et al. (Apr. 3, 2015). "The Future of Immune Checkpoint Therapy," Science 348(6230):56-61.

Shields, R.L. et al. (Mar. 2, 2001). "High Resolution Mapping of the Binding Site on Human IgG1 for FcγRI, FcγII, FcγIII, and FcRn and Design of IgG1 Variants With Improved Binding to the FcγR," J. Biol.Chem. 276(9):6591-6604.

Shultz, L.D. et al. (Jul. 2014). "Human Cancer Growth and Therapy in NOD/SCID/IL2Rβnull (NSG) Mice," Cold Spring Harb. Protoc. 2014(7):694-708, 24 pages.

Smith, E.J. et al. (Dec. 11, 2015). "A Novel, Native-Format Bispecific Antibody Triggering T-cell Killing of B-cells is Robustly Active in Mouse Tumor Models and Cynomolgus Monkeys," Sci Rep 5(17943):1-12.

Song, Li-Ping et al. (Jun. 1, 2003). "A New Model of Trispecific Antibody with Cytotoxicity Against Tumor Cells," Acta Biochimica Etbiophysica Sinica 35(6):503-510.

Spiess et al, The Journal of Biological Chemistry; Sep. 2013; 288(37):26583-26593.

Spiess, C. et al. (2015, e-pub. Jan. 27, 2015). "Alternative Molecular Formats and Therapeutic Applications for Bispecific Antibodies," Mol. Immunol. 67:95-106.

Stebbings, R. et al. (Sep. 1, 2007). ""Cytokine Storm" In the Phase I Trial of Monoclonal Antibody TGN1412: Better Understanding the Causes to Improve Preclinical Testing of Immunotherapeutics," J. Immunol. 179 (5):3325-3331.

Steinmetz, A. et al. (Mar. 16, 2016). "CODV-Ig, A Universal Bispecific Tetravalent and Multifunctional Immunoglobulin Format for Medical Applications," MABS 8(5):867-878, with Supplementary material, 59 pages.

Stevenson, G.T. (Nov.-Dec. 2006). "CD38 as a Therapeutic Target," Mol. Med. 12(11-12):345-346.

Suntharalingam, G. et al. (Sep. 7, 2006). "Cytokine Storm in a Phase 1 Trial of the Anti-CD28 Monoclonal Antibody TGN1412," N Engl J Med 355(10):1018-1028.

Tabares, P. et al. (Apr. 2014; e-pub. Feb. 1, 2014). "Human Regulatory T Cells are Selectively Activated by Low-Dose Application of the CD28 Superagonist TGN1412/TAB08," Eur J Immunol. 44:1225-1236.

Thompson, J.D. (Nov. 11, 1994). "Clustal W: Improving the Sensitivity of Progressive Multiple Sequence Alignment Through Sequence Weighting, Position-Specific Gap Penalties and Weight Matrix Choice," Nucleic Acids Res. 22(22):4673-4680.

Tiller, T. et al. (Oct. 2009). "Cloning and Expression of Murine Ig Genes From Single B Cells," J. Immunol. Methods 350(1-2):183-193.

U.S. Appl. No. 16/596,474, filed Oct. 8, 2019, for Wu et al. (Copy not submitted herewith pursuant to the waiver of 37 C.F.R. 1.98(a)(2)(iii) issued by the Office on Sep. 21, 2004).

U.S. Appl. No. 16/843,792, filed Apr. 8, 2020, for Asokan et al. (Copy not submitted herewith pursuant to the waiver of 37 C.F.R. 1.98(a)(2)(iii) issued by the Office on Sep. 21, 2004).

Waibler, Z. et al. (Mar. 5, 2008). "Signaling Signatures and Functional Properties of Anti-Human CD28 Superagonistic Antibodies," PLoS One 3(3):e1708, pp. 1-13.

Wang, X. (Apr. 1, 2004). "A New Recombinant Single Chain Trispecific Antibody Recruits T Lymphocytes to Kill CEA (Carcinoma Embryonic Antigen) Positive Tumor Cells in Vitro Efficiently," Journal of Biochemistry 135(4):555-565.

Wang, X. et al. (Jan. 2018; e-pub. Oct. 6, 2017). "IgG Fc Engineering to Modulate Antibody Effector Functions," Protein & Cell 9(1):63-73.

Wennerberg, A.E. et al. (Oct. 1993). "Hepatocyte Paraffin 1: A Monoclonal Antibody that Reacts with Hepatocytes and can be Used for Differential Diagnosis of Hepatic Tumors," Am J Pathol. 143(4):1050-1054.

Written Opinion of the International Searching Authority dated Dec. 17, 2019, for PCT Application No. PCT/US2019/055232, filed on Oct. 8, 2019, six pages.

Wu, L. et al. (Nov. 18, 2019). "Trispecific Antibodies Enhance the Therapeutic Efficacy of Tumor-Directed T Cells Through T Cell Receptor Co-Stimulation," Nat Cancer 1:86-98.

Xu, L. et al. (Oct. 6, 2017; e-pub. Sep. 20, 2017). "Trispecific Broadly Neutralizing HIV Antibodies Mediate Potent SHIV Protection in Macaques," Science 358(6359):85-90, 17 pages.

U.S. Appl. No. 17/099,439, filed Nov. 16, 2020, for Yang et al. (Copy not submitted herewith pursuant to the waiver of 37 C.F.R. 1.98(a)(2)(iii) issued by the Office on Sep. 21, 2004).

MPER-V1/V2 directed "a" Ab

V1/V2 directed "a"-MPER Ab

------- Superdex 200 16 600 BisAb CODV4026:10 Inject

Aggregates 48.39    64.29  Monomer 55.15

FIG. 4A

Format - Trispecific T Cell Engager

Format - Trispecific T Cell Engager

BIVALENT, BISPECIFIC BINDING PROTEINS FOR PREVENTION OR TREATMENT OF HIV INFECTION

CROSS REFERENCES TO RELATED APPLICATIONS

This is a continuation of U.S. patent application Ser. No. 15/770,471, filed on Apr. 23, 2018, which is a National Phase application under 35 U.S.C. § 371 of International Application No. PCT/US2016/058540, filed Oct. 24, 2016, which claims the priority benefit of U.S. Provisional Application Ser. No. 62/246,113, filed Oct. 25, 2015, EP Application No. EP16305211.1, filed Feb. 24, 2016, U.S. Provisional Application No. 62/322,029, filed Apr. 13, 2016, and U.S. Provisional Application No. 62/331,169, filed May 3, 2016, which are incorporated herein by reference in their entirety.

This invention was created in the performance of a Cooperative Research and Development Agreement (NIAID #2014-0038) with the National Institutes of Health, an agency of the Department of Health and Human Services. The Government of the United States has certain rights in this invention.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 183952027001SEQLIST.txt, date recorded: Oct. 21, 2019, size: 1,064 KB).

FIELD OF THE INVENTION

The disclosure relates to trispecific and/or trivalent binding proteins comprising four polypeptide chains that form three antigen binding sites that specifically bind one or more HIV target proteins, wherein a first pair of polypeptides forming the binding protein possess dual variable domains having a cross-over orientation and wherein a second pair of polypeptides forming the binding protein possess a single variable domain. The disclosure also relates to methods for making trispecific and/or trivalent binding proteins and uses of such binding proteins for treating and/or preventing HIV/AIDS.

BACKGROUND

One of the challenges in treating HIV/AIDS with neutralizing antibodies is potential breakthrough infection due to the high mutation rate of HIV-1 viruses. Additionally, virological events in the early weeks following HIV-1 transmission set the stage for lifelong chronic infection that remains incurable with currently available combination antiretroviral therapy (cART). This is due, at least in part, to the early establishment of viral reservoirs, including latently infected cells, which persist despite cART, leading to recrudescent infection when treatment is interrupted. Newly discovered anti-HIV-1 neutralizing antibodies with improved breadth and potency may provide more options for HIV/AIDS treatment and prevention; however, breakthrough infection remains a major issue in the field.

BRIEF SUMMARY

In one embodiment, the disclosure provides a binding protein comprising four polypeptide chains that form three antigen binding sites that specifically bind one or more HIV target proteins, wherein a first polypeptide chain comprises a structure represented by the formula:

$$V_{L2}\text{-}L_1\text{-}V_{L1}\text{-}L_2\text{-}C_L \quad \text{[I]};$$

a second polypeptide chain comprises a structure represented by the formula:

$$V_{H1}\text{-}L_3\text{-}V_{H2}\text{-}L_4\text{-}C_{H1} \quad \text{[II]};$$

a third polypeptide chain comprises a structure represented by the formula:

$$V_{H3}\text{-}C_{H1} \quad \text{[III]};$$

and a fourth polypeptide chain comprises a structure represented by the formula:

$$V_{L3}\text{-}C_L \quad \text{[IV]};$$

wherein
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is an immunoglobulin $C_{H1}$ heavy chain constant domain; and
$L_1$, $L_2$, $L_3$, and $L_4$ are amino acid linkers;
and wherein the polypeptide of formula I and the polypeptide of formula II form a cross-over light chain-heavy chain pair.

In some embodiments, the second polypeptide chain further comprises an Fc region linked to $C_{H1}$, the Fc region comprising an immunoglobulin hinge region and $C_{H2}$ and $C_{H3}$ immunoglobulin heavy chain constant domains. In some embodiments, the third polypeptide chain further comprises an Fc region linked to $C_{H1}$, the Fc region comprising an immunoglobulin hinge region and $C_{H2}$ and $C_{H3}$ immunoglobulin heavy chain constant domains. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 354 and 366 of human IgG1 according to EU Index, wherein the amino acid substitutions are S354C and T366W; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 349, 366, 368, and 407 of human IgG1 according to EU Index, wherein the amino acid substitutions are Y349C, T366S, L368A, and Y407V. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 349, 366, 368, and 407 of human IgG1 according to EU Index, wherein the amino acid substitutions are Y349C, T366S, L368A, and Y407V; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 354 and 366 of human IgG1 according to EU Index, wherein the amino acid substitutions are S354C and T366W. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains; wherein the first and second Fc regions comprise amino acid substitutions at positions corresponding to positions 428 and 434 of human IgG1 according to EU Index, wherein the amino acid substitutions are M428L and N434S.

In one embodiment, the disclosure provides a binding protein comprising four polypeptide chains that form three antigen binding sites that specifically bind one or more HIV target proteins, wherein a first polypeptide chain comprises a structure represented by the formula:

$$V_{L2}\text{-}L_1\text{-}V_{L1}\text{-}L_2\text{-}C_L \qquad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \qquad [II]$$

and a third polypeptide chain comprises a structure represented by the formula:

$$V_{H3}\text{-}C_{H1}\text{-hinge-}C_{H2}\text{-}C_{H3} \qquad [III]$$

and a fourth polypeptide chain comprises a structure represented by the formula:

$$V_{L3}\text{-}C_L \qquad [IV]$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is an immunoglobulin $C_{H1}$ heavy chain constant domain;
$C_{H2}$ is an immunoglobulin $C_{H2}$ heavy chain constant domain;
$C_{H3}$ is an immunoglobulin $C_{H3}$ heavy chain constant domain;
hinge is an immunoglobulin hinge region connecting the $C_{H1}$ and $C_{H2}$ domains; and
$L_1$, $L_2$, $L_3$ and $L_4$ are amino acid linkers;
and wherein the polypeptide of formula I and the polypeptide of formula II form a cross-over light chain-heavy chain pair.

In some embodiments, the $C_{H3}$ domain of the second polypeptide chain comprises amino acid substitutions at positions corresponding to positions 354 and 366 of human IgG1 according to EU Index, wherein the amino acid substitutions are S354C and T366W; and wherein the $C_{H3}$ domain of the third polypeptide chain comprises amino acid substitutions at positions corresponding to positions 349, 366, 368, and 407 of human IgG1 according to EU Index, wherein the amino acid substitutions are Y349C, T366S, L368A, and Y407V. In some embodiments, the $C_{H3}$ domain of the second polypeptide chain comprises amino acid substitutions at positions corresponding to positions 349, 366, 368, and 407 of human IgG1 according to EU Index, wherein the amino acid substitutions are Y349C, T366S, L368A, and Y407V; and wherein the $C_{H3}$ domain of the third polypeptide chain comprises amino acid substitutions at positions corresponding to positions 354 and 366 of human IgG1 according to EU Index, wherein the amino acid substitutions are S354C and T366W. In some embodiments, the $C_{H3}$ domains of the second and the third polypeptide chains both comprise amino acid substitutions at positions corresponding to positions 428 and 434 of human IgG1 according to EU Index, wherein the amino acid substitutions are M428L and N434S.

In some embodiments, the one or more HIV target protein is selected from the group consisting of glycoprotein 120, glycoprotein 41 and glycoprotein 160. In some embodiments, the binding protein is trispecific and capable of specifically binding three different epitopes on a single HIV target protein. In some embodiments, the binding protein is trispecific and capable of specifically binding two different epitopes on a first HIV target protein, and one epitope on a second HIV target protein, wherein the first and second HIV target proteins are different. In some embodiments, the binding protein is trispecific and capable of specifically binding three different antigen targets. In some embodiments, the binding protein is capable of inhibiting the function of one or more HIV target proteins. In some embodiments, $V_{L1}$ comprises a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; or a sequence as set forth in SEQ ID NOs: 278, 279, and 280, respectively. In some embodiments, $V_{L1}$ comprises a CDR-L1, CDR-L2, and CDR-L3 of a light chain variable domain comprising a sequence selected from the group consisting of SEQ ID NOs: 512, 513, 514, 515, 516, 517, 518, 519, 520, and 521. In some embodiments, $V_{L1}$ comprises a light chain variable domain comprising a sequence selected from the group consisting of SEQ ID NOs: 512, 513, 514, 515, 516, 517, 518, 519, 520, and 521. In some embodiments, $V_{L2}$ comprises a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; or a sequence as set forth in SEQ ID NOs: 278, 279, and 280, respectively. In some embodiments, $V_{L2}$ comprises a CDR-L1, CDR-L2, and CDR-L3 of a light chain variable domain comprising a sequence selected from the group consisting of SEQ ID NOs: 512, 513, 514, 515, 516, 517, 518, 519, 520, and 521. In some embodiments, $V_{L2}$ comprises a light chain variable domain comprising a sequence selected from the group consisting of SEQ ID NOs: 512, 513, 514, 515, 516, 517, 518, 519, 520, and 521. In some embodiments, $V_{L3}$ comprises a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; or a sequence as set forth in SEQ ID NOs: 278, 279, and 280, respectively. In some embodiments, $V_{L3}$ comprises a CDR-L1, CDR-L2, and CDR-L3 of a light chain variable domain comprising a sequence selected from the group consisting of SEQ ID NOs: 512, 513, 514, 515, 516, 517, 518, 519, 520, and 521. In some embodiments, $V_{L3}$ comprises a light chain variable domain comprising a sequence selected from the group consisting of SEQ ID NOs: 512, 513, 514, 515, 516, 517, 518, 519, 520, and 521. In some embodiments, $V_{H1}$ comprises a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; or a sequence as set forth in SEQ ID NOs: 499, 261, and 262, respectively. In some embodiments, $V_{H1}$ comprises a CDR-H1, CDR-H2, and CDR-H3 of a heavy chain variable domain comprising a sequence selected from the group consisting of SEQ ID NOs: 502, 503, 504, 505, 506, 507, and 508. In some embodiments, $V_{H1}$ comprises a heavy chain variable domain comprising a sequence selected from the group consisting of SEQ ID NOs: 502, 503, 504, 505, 506, 507, and 508. In some embodiments, $V_{H2}$ comprises a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; or a sequence as set forth in SEQ ID NOs: 499, 261, and 262, respectively. In some embodiments, $V_{H2}$ comprises a CDR-H1, CDR-H2, and CDR-H3 of a heavy chain variable domain comprising a sequence selected from the group consisting of SEQ ID NOs: 502, 503, 504, 505, 506, 507, and 508. In some embodiments, $V_{H2}$ comprises a heavy chain variable domain comprising a sequence selected from the group consisting of SEQ ID NOs: 502, 503, 504, 505, 506, 507, and 508. In some embodiments, $V_{H3}$ comprises a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; or a sequence as set forth in SEQ ID NOs: 499, 261, and 262, respectively. In some embodiments, $V_{H3}$ comprises a CDR-H1, CDR-H2, and CDR-H3 of a heavy chain variable domain comprising a sequence selected from the group consisting of SEQ ID NOs: 502, 503, 504, 505, 506, 507, and 508. In some embodiments, $V_{H3}$ comprises a heavy chain variable domain comprising a sequence selected from the group consisting of SEQ ID NOs: 502, 503, 504, 505, 506, 507, and 508. In some embodiments, $V_{L1}$ comprises a CDR-L1 comprising the sequence of SEQ ID NO: 500, a CDR-L2 comprising the sequence of SEQ ID NO: 501, and a CDR-L3 comprising the sequence of SEQ ID NO: 274; $V_{L2}$ comprises a CDR-L1 comprising the sequence of SEQ ID NO: 275, a CDR-L2 comprising the sequence of SEQ ID NO: 276, and a CDR-L3 comprising the sequence of SEQ ID NO: 277; $V_{L3}$ comprises a CDR-L1 comprising the sequence of SEQ ID NO: 266, a CDR-L2 comprising the sequence of SEQ ID NO: 267, and a CDR-L3 comprising the sequence of SEQ ID NO: 268; $V_{H1}$ comprises a CDR-H1 comprising the sequence of SEQ ID NO: 254, a CDR-H2 comprising the sequence of SEQ ID NO: 255, and a CDR-H3 comprising the sequence of SEQ ID NO: 256; $V_{H2}$ comprises a CDR-H1 comprising the sequence of SEQ ID NO: 257, a CDR-H2 comprising the sequence of SEQ ID NO: 258, and a CDR-H3 comprising the sequence of SEQ ID NO: 259; and $V_{H3}$ comprises a CDR-H1 comprising the sequence of SEQ ID NO: 248, a CDR-H2 comprising the sequence of SEQ ID NO: 497, and a CDR-H3 comprising the sequence of SEQ ID NO: 250. In some embodiments, $V_{L1}$ comprises a CDR-L1, CDR-L2, and CDR-L3 of a light chain variable domain comprising the light chain variable domain sequence of SEQ ID NO: 518; $V_{L2}$ comprises a CDR-L1, CDR-L2, and CDR-L3 of a light chain variable domain comprising the light chain variable domain sequence of SEQ ID NO: 519; $V_{L3}$ comprises a CDR-L1, CDR-L2, and CDR-L3 of a light chain variable domain comprising the light chain variable domain sequence of SEQ ID NO: 512; $V_{H1}$ comprises a CDR-H1, CDR-H2, and CDR-H3 of a heavy chain variable domain comprising the heavy chain variable domain sequence of SEQ ID NO: 504; $V_{H2}$ comprises a CDR-H1, CDR-H2, and CDR-H3 of a heavy chain variable domain comprising the heavy chain variable domain sequence of SEQ ID NO: 506; and $V_{H3}$ comprises a CDR-H1, CDR-H2, and CDR-H3 of a heavy chain variable domain comprising the heavy chain variable domain sequence of SEQ ID NO: 502. In some embodiments, $V_{L1}$ comprises a light chain variable domain comprising the sequence of SEQ ID NO: 518; $V_{L2}$ comprises a light chain variable domain comprising the sequence of SEQ ID NO: 519; $V_{L3}$ comprises a light chain variable domain comprising the sequence of SEQ ID NO: 512; $V_{H1}$ comprises a heavy chain variable domain comprising the sequence of SEQ ID NO: 504; $V_{H2}$ comprises a heavy chain variable domain comprising the sequence of SEQ ID NO: 506; and $V_{H3}$ comprises a heavy chain variable domain comprising the sequence of SEQ ID NO: 502. In some embodiments, $V_{L1}$ comprises a CDR-L1 comprising the sequence of SEQ ID NO: 500, a CDR-L2 comprising the sequence of SEQ ID NO: 501, and a CDR-L3 comprising the sequence of SEQ ID NO: 274; $V_{L2}$ comprises a CDR-L1 comprising the sequence of SEQ ID NO: 275, a CDR-L2 comprising the sequence of SEQ ID NO: 276, and a CDR-L3 comprising the sequence of SEQ ID NO: 277; $V_{L3}$ comprises a CDR-L1 comprising the sequence of SEQ ID NO: 269, a CDR-L2 comprising the sequence of SEQ ID NO: 270, and a CDR-L3 comprising the sequence of SEQ ID NO: 271; $V_{H1}$ comprises a CDR-H1 comprising the sequence of SEQ ID NO: 254, a CDR-H2 comprising the sequence of SEQ ID NO: 255, and a CDR-H3 comprising the sequence of SEQ ID NO: 256; $V_{H2}$ comprises a CDR-H1 comprising the sequence of SEQ ID NO: 257, a CDR-H2 comprising the sequence of SEQ ID NO: 258, and a CDR-H3 comprising the sequence of SEQ ID NO: 259; and $V_{H3}$ comprises a CDR-H1 comprising the sequence of SEQ ID NO: 251, a CDR-H2 comprising the sequence of SEQ ID NO: 252, and a CDR-H3 comprising the sequence of SEQ ID NO: 253. In some embodiments, $V_{L1}$ comprises a CDR-L1, CDR-L2, and CDR-L3 of a light chain variable domain comprising the light chain variable domain sequence of SEQ ID NO: 518; $V_{L2}$ comprises a CDR-L1, CDR-L2, and CDR-L3 of a light chain variable domain comprising the light chain variable domain sequence of SEQ ID NO: 519; $V_{L3}$ comprises a CDR-L1, CDR-L2, and CDR-L3 of a light chain variable domain comprising the light chain variable domain sequence of SEQ ID NO: 513; $V_{H1}$ comprises a CDR-H1, CDR-H2, and CDR-H3 of a heavy chain variable domain comprising the heavy chain variable domain sequence of SEQ ID NO: 504; $V_{H2}$ comprises a CDR-H1, CDR-H2, and CDR-H3 of a heavy chain variable domain comprising the heavy chain variable domain sequence of SEQ ID NO: 506; and $V_{H3}$ comprises a CDR-H1, CDR-H2, and CDR-H3 of a heavy chain variable domain comprising the heavy chain variable domain sequence of SEQ ID NO: 503. In some embodiments, $V_{L1}$ comprises a light chain variable domain comprising the sequence of SEQ ID NO: 518; $V_{L2}$ comprises a light chain variable domain comprising the sequence of SEQ ID NO: 519; $V_{L3}$ comprises a light chain variable domain comprising the sequence of SEQ ID NO: 513; $V_{H1}$ comprises a heavy chain variable domain comprising the sequence of SEQ ID NO: 504; $V_{H2}$ comprises a heavy chain variable domain comprising the sequence of SEQ ID NO: 506; and $V_{H3}$ comprises a heavy chain variable domain comprising the sequence of SEQ ID NO: 503. In some embodiments, $V_{L1}$ comprises a CDR-L1 comprising the sequence of SEQ ID NO: 275, a CDR-L2 comprising the sequence of SEQ ID NO: 276, and a CDR-L3 comprising the sequence of SEQ ID NO: 277; $V_{L2}$ comprises a CDR-L1 comprising the sequence of SEQ ID NO: 500, a CDR-L2 comprising the sequence of SEQ ID NO: 501, and a CDR-L3 comprising the sequence of SEQ ID NO: 274; $V_{L3}$ comprises a CDR-L1 comprising the sequence of SEQ ID NO: 269, a CDR-L2 comprising the sequence of SEQ ID NO: 270, and a CDR-L3 comprising the sequence of SEQ ID NO: 271; $V_{H1}$ comprises a CDR-H1 comprising the sequence of SEQ ID NO: 257, a CDR-H2 comprising the sequence of SEQ ID NO: 258, and a CDR-H3 comprising the sequence of SEQ ID NO: 259; $V_{H2}$ comprises a CDR-H1 comprising the sequence of SEQ ID NO: 254, a CDR-H2 comprising the sequence of SEQ ID NO: 255, and a CDR-H3 comprising the sequence of SEQ ID NO: 256; and $V_{H3}$ comprises a CDR-H1 comprising the sequence of SEQ ID NO: 251, a CDR-H2 comprising the sequence of SEQ ID NO: 252, and a CDR-H3 comprising the sequence of SEQ ID NO: 253. In some embodiments, $V_{L1}$ comprises a CDR-L1, CDR-L2, and CDR-L3 of a light chain variable domain comprising the light chain variable domain sequence of SEQ ID NO: 519; $V_{L2}$ comprises a CDR-L1, CDR-L2, and CDR-L3 of a light chain variable domain comprising the light chain variable domain sequence of SEQ ID NO: 518; $V_{L3}$ comprises a CDR-L1, CDR-L2, and CDR-L3 of a light chain variable domain comprising the light chain variable domain sequence of SEQ ID NO: 513; $V_{H1}$ comprises a CDR-H1, CDR-H2, and CDR-H3 of a heavy chain variable domain comprising the heavy chain variable domain sequence of SEQ ID NO: 506; $V_{H2}$ comprises a CDR-H1, CDR-H2, and CDR-H3 of a heavy chain variable domain comprising the heavy chain variable domain sequence of SEQ ID NO: 504; and $V_{H3}$ comprises a CDR-H1, CDR-H2, and CDR-H3 of a heavy chain variable domain comprising the heavy chain variable domain sequence of SEQ ID NO: 503. In some embodiments, $V_{L1}$ comprises a light chain variable domain comprising the sequence of SEQ ID NO: 519; $V_{L2}$ comprises a light chain variable domain comprising the sequence of SEQ ID NO: 518; $V_{L3}$ comprises a light chain variable domain comprising the sequence of SEQ ID NO: 513; $V_{H1}$ comprises a heavy chain variable domain comprising the sequence of SEQ ID NO: 506; $V_{H2}$ comprises a heavy chain variable domain comprising the sequence of SEQ ID NO: 504; and $V_{H3}$ comprises a heavy chain variable domain comprising the sequence of SEQ ID NO: 503. In some embodiments, at least one of $L_1$, $L_2$, $L_3$, or $L_4$ is independently 0 amino acids in length. In some embodiments, $L_1$, $L_2$, $L_3$, or $L_4$ are each independently at least one amino acid in length. In some embodiments, $L_1$ comprises Asp-Lys-Thr-His-Thr (SEQ ID NO: 525).

In one embodiment, the disclosure provides a binding protein comprising four polypeptide chains that form three antigen binding sites, wherein a first polypeptide chain comprises a structure represented by the formula:

$$V_{L2}\text{-}L_1\text{-}V_{L1}\text{-}L_2\text{-}C_L \quad \text{[I]}$$

and a second polypeptide chain comprises a structure represented by the formula:

$$V_{H1}\text{-}L_3\text{-}V_{H2}\text{-}L_4\text{-}C_{H1} \quad \text{[II]}$$

and a third polypeptide chain comprises a structure represented by the formula:

$$V_{H3}\text{-}C_{H1} \quad \text{[III]}$$

and a fourth polypeptide chain comprises a structure represented by the formula:

$$V_{L3}\text{-}C_L \quad \text{[IV]}$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$, and $L_4$ are amino acid linkers;
wherein the polypeptide of formula I and the polypeptide of formula II form a cross-over light chain-heavy chain pair;
wherein:

(a) $V_{L1}$, $V_{L2}$ and $V_{L3}$ are each independently a variable domain derived from an amino acid sequence as set forth in any one of SEQ ID NOs: 2, 4, 10, 12, 18, 20, 26, 28, 34, 36, 42, 44, 50, 52, 58, 60, 66, 68, 74, 76, 82, 84, 90, 92, 98, 100, 106, 108, 114, 116, 122, 124, 130, 132, 138, 140, 146, 148, 154, 156, 162, 164, 170, 172, 178, 180, 186, 188, 194, 196, 202, 204, 210, 212, 218, 220, 226, 228, 233, 235, 241, 243; or (b) $V_{L1}$, $V_{L2}$ and $V_{L3}$ each independently comprise light chain complementarity determining regions of a variable domain comprising an amino acid sequence as set forth in any one of SEQ ID NOs: 266-283; and
wherein:

(a) $V_{H1}$, $V_{H2}$, and $V_{H3}$ are each independently a variable domain derived from an amino acid sequence as set forth in any one of SEQ ID NOs: 1, 3, 9, 11, 17, 10, 25, 27, 33, 35, 41, 43, 49, 51, 57, 59, 65, 67, 73, 75, 81, 83, 89, 91, 97, 99, 105, 107, 113, 115, 121, 123, 129, 131, 137, 139, 145, 147, 153, 155, 161, 163, 169, 171, 177, 179, 185, 187, 193, 195, 201, 203, 209, 211, 217, 219, 225, 227, 232, 234, 240, 242; or (b) $V_{H1}$, $V_{H2}$, and $V_{H3}$ each independently comprise heavy chain complementarity determining regions of a variable domain comprising an amino acid sequence as set forth in any one of SEQ ID NOs: 248-265.

In some embodiments, the second polypeptide chain further comprises an Fc region linked to $C_{H1}$, the Fc region comprising an immunoglobulin hinge region and $C_{H2}$ and $C_{H3}$ immunoglobulin heavy chain constant domains. In some embodiments, the third polypeptide chain further comprises an Fc region linked to $C_{H1}$, the Fc region comprising an immunoglobulin hinge region and $C_{H2}$ and $C_{H3}$ immunoglobulin heavy chain constant domains. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 354 and 366 of human IgG1 according to EU Index, wherein the amino acid substitutions are S354C and T366W; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 349, 366, 368, and 407 of human IgG1 according to EU Index, wherein the amino acid substitutions are Y349C, T366S, L368A, and Y407V. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 349, 366, 368, and 407 of human IgG1 according to EU Index, wherein the amino acid substitutions are Y349C, T366S, L368A, and Y407V; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 354 and 366 of human IgG1 according to EU Index, wherein the amino acid substitutions are S354C and T366W. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains; wherein the first and second Fc regions comprise amino acid substitutions at positions corresponding to positions 428 and 434 of human IgG1 according to EU Index, wherein the amino acid substitutions are M428L and N434S.

In one embodiment, the disclosure provides a binding protein comprising four polypeptide chains that form three antigen binding sites, wherein a first polypeptide chain comprises a structure represented by the formula:

$$V_{L2}\text{-}L_1\text{-}V_{L1}\text{-}L_2\text{-}C_L \quad [\text{I}]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [\text{II}]$$

and a third polypeptide chain comprises a structure represented by the formula:

$$V_{H3}\text{-}C_{H1}\text{-hinge-}C_{H2}\text{-}C_{H3} \quad [\text{III}]$$

and a fourth polypeptide chain comprises a structure represented by the formula:

$$V_{L3}\text{-}C_L \quad [\text{IV}]$$

wherein:

$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain;
$C_{H2}$ is an immunoglobulin $C_{H2}$ heavy chain constant domain;
$C_{H3}$ is an immunoglobulin $C_{H3}$ heavy chain constant domain;
hinge is an immunoglobulin hinge region connecting the $C_{H1}$ and $C_{H2}$ domains; and
$L_1$, $L_2$, $L_3$, and $L_4$ are amino acid linkers;
wherein the polypeptide of formula I and the polypeptide of formula II form a cross-over light chain-heavy chain pair; wherein:

(a) $V_{L1}$, $V_{L2}$ and $V_{L3}$ are each independently a variable domain derived from an amino acid sequence as set forth in any one of SEQ ID NOs: 2, 4, 10, 12, 18, 20, 26, 28, 34, 36, 42, 44, 50, 52, 58, 60, 66, 68, 74, 76, 82, 84, 90, 92, 98, 100, 106, 108, 114, 116, 122, 124, 130, 132, 138, 140, 146, 148, 154, 156, 162, 164, 170, 172, 178, 180, 186, 188, 194, 196, 202, 204, 210, 212, 218, 220, 226, 228, 233, 235, 241, 243; or (b) $V_{L1}$, $V_{L2}$ and $V_{L3}$ each independently comprise light chain complementarity determining regions of a variable domain comprising an amino acid sequence as set forth in any one of SEQ ID NOs: 266-283; and
wherein:

(a) $V_{H1}$, $V_{H2}$, and $V_{H3}$ are each independently a variable domain derived from an amino acid sequence as set forth in any one of SEQ ID NOs: 1, 3, 9, 11, 17, 10, 25, 27, 33, 35, 41, 43, 49, 51, 57, 59, 65, 67, 73, 75, 81, 83, 89, 91, 97, 99, 105, 107, 113, 115, 121, 123, 129, 131, 137, 139, 145, 147, 153, 155, 161, 163, 169, 171, 177, 179, 185, 187, 193, 195, 201, 203, 209, 211, 217, 219, 225, 227, 232, 234, 240, 242; or (b) $V_{H1}$, $V_{H2}$, and $V_{H3}$ each independently comprise heavy chain complementarity determining regions of a variable domain comprising an amino acid sequence as set forth in any one of SEQ ID NOs: 248-265.

In some embodiments, the $C_{H3}$ domain of the second polypeptide chain comprises amino acid substitutions at positions corresponding to positions 354 and 366 of human IgG1 according to EU Index, wherein the amino acid substitutions are S354C and T366W; and wherein the $C_{H3}$ domain of the third polypeptide chain comprises amino acid substitutions at positions corresponding to positions 349, 366, 368, and 407 of human IgG1 according to EU Index, wherein the amino acid substitutions are Y349C, T366S, L368A, and Y407V. In some embodiments, the $C_{H3}$ domain of the second polypeptide chain comprises amino acid substitutions at positions corresponding to positions 349, 366, 368, and 407 of human IgG1 according to EU Index, wherein the amino acid substitutions are Y349C, T366S, L368A, and Y407V; and wherein the $C_{H3}$ domain of the third polypeptide chain comprises amino acid substitutions at positions corresponding to positions 354 and 366 of human IgG1 according to EU Index, wherein the amino acid substitutions are S354C and T366W. In some embodiments, the $C_{H3}$ domains of the second and the third polypeptide chains both comprise amino acid substitutions at positions corresponding to positions 428 and 434 of human IgG1 according to EU Index, wherein the amino acid substitutions are M428L and N434S.

In some embodiments, at least one of $L_1$, $L_2$, $L_3$, or $L_4$ is independently 0 amino acids in length. In some embodiments, $L_1$, $L_2$, $L_3$, or $L_4$ are each independently at least one amino acid in length. In some embodiments, $L_1$ comprises Asp-Lys-Thr-His-Thr (SEQ ID NO: 525).

In one embodiment, the disclosure provides a trispecific and/or trivalent binding protein comprising four polypeptide chains that form three antigen binding sites that specifically bind three different HIV target proteins, wherein a first polypeptide chain has a structure represented by the formula:

  [I]

and a second polypeptide chain has a structure represented by the formula:

  [II]

and a third polypeptide chain has a structure represented by the formula:

  [III]

and a fourth polypeptide chain has a structure represented by the formula:

  [IV]

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$ and $L_4$ are amino acid linkers;
and wherein the polypeptide of formula I and the polypeptide of formula II form a cross-over light chain-heavy chain pair.

In one embodiment, the disclosure provides a binding protein comprising four polypeptide chains that form three antigen binding sites, wherein a first polypeptide chain has a structure represented by the formula:

  [I]

and a second polypeptide chain has a structure represented by the formula:

  [II]

and a third polypeptide chain has a structure represented by the formula:

  [III]

and a fourth polypeptide chain has a structure represented by the formula:

  [IV]

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$, and $L_4$ are amino acid linkers;
wherein the polypeptide of formula I and the polypeptide of formula II form a cross-over light chain-heavy chain pair;
wherein:
(a) $V_{L1}$, $V_{L2}$ and $V_{L3}$ are each independently a variable domain derived from an amino acid sequence as set forth in any one of SEQ ID NOs: 2, 4, 10, 12, 18, 20, 26, 28, 34, 36, 42, 44, 50, 52, 58, 60, 66, 68, 74, 76, 82, 84, 90, 92, 98, 100, 106, 108, 114, 116, 122, 124, 130, 132, 138, 140, 146, 148, 154, 156, 162, 164, 170, 172, 178, 180, 186, 188, 194, 196, 202, 204, 210, 212, 218, 220, 226, 228, 233, 235, 241, 243; or
(b) $V_{L1}$, $V_{L2}$ and $V_{L3}$ each independently comprise light chain complementarity determining regions of a variable domain comprising an amino acid sequence as set forth in any one of SEQ ID NOs:266-283; and
wherein:
(a) $V_{H1}$, $V_{H2}$, and $V_{H3}$ are each independently a variable domain derived from an amino acid sequence as set forth in any one of SEQ ID NOs: 1, 3, 9, 11, 17, 10, 25, 27, 33, 35, 41, 43, 49, 51, 57, 59, 65, 67, 73, 75, 81, 83, 89, 91, 97, 99, 105, 107, 113, 115, 121, 123, 129, 131, 137, 139, 145, 147, 153, 155, 161, 163, 169, 171, 177, 179, 185, 187, 193, 195, 201, 203, 209, 211, 217, 219, 225, 227, 232, 234, 240, 242; or
(b) $V_{H1}$, $V_{H2}$, and $V_{H3}$ each independently comprise heavy chain complementarity determining regions of a variable domain comprising an amino acid sequence as set forth in any one of SEQ ID NOs: 248-265.

In another embodiment, the disclosure provides a binding protein comprising a first polypeptide chain, a second polypeptide chain, a third polypeptide chain and a fourth polypeptide chain wherein:
(a) the first polypeptide chain comprises the amino acid sequence of SEQ ID NO: 4 or an amino acid sequence that is at least 95% identical to the amino acid sequence of SEQ ID NO: 4; the second polypeptide chain comprises the amino acid sequence of SEQ ID NO: 3 or an amino acid sequence that is at least 95% identical to the amino acid sequence of SEQ ID NO: 3; the third polypeptide chain comprises the amino acid sequence of SEQ ID NO: 1 or an amino acid sequence that is at least 95% identical to the amino acid sequence of SEQ ID NO: 1; and the fourth polypeptide chain comprises the amino acid sequence of SEQ ID NO: 2 or an amino acid sequence that is at least 95% identical to the amino acid sequence of SEQ ID NO: 2;
(b) the first polypeptide chain comprises the amino acid sequence of SEQ ID NO: 12 or an amino acid sequence that is at least 95% identical to the amino acid sequence of SEQ ID NO: 12; the second polypeptide chain comprises the amino acid sequence of SEQ ID NO: 11 or an amino acid sequence that is at least 95% identical to the amino acid sequence of SEQ ID NO: 11; the third polypeptide chain comprises the amino acid sequence of SEQ ID NO: 9 or an amino acid sequence that is at least 95% identical to the amino acid sequence of SEQ ID NO: 9; and the fourth polypeptide chain comprises the amino acid sequence of SEQ ID NO: 10 or an amino acid sequence that is at least 95% identical to the amino acid sequence of SEQ ID NO: 10;

(c) the first polypeptide chain comprises the amino acid sequence of SEQ ID NO: 20 or an amino acid sequence that is at least 95% identical to the amino acid sequence of SEQ ID NO: 20; the second polypeptide chain comprises the amino acid sequence of SEQ ID NO: 19 or an amino acid sequence that is at least 95% identical to the amino acid sequence of SEQ ID NO: 19; the third polypeptide chain comprises the amino acid sequence of SEQ ID NO: 17 or an amino acid sequence that is at least 95% identical to the amino acid sequence of SEQ ID NO: 17; and the fourth polypeptide chain comprises the amino acid sequence of SEQ ID NO: 18 or an amino acid sequence that is at least 95% identical to the amino acid sequence of SEQ ID NO: 18;

(d) the first polypeptide chain comprises the amino acid sequence of SEQ ID NO: 28 or an amino acid sequence that is at least 95% identical to the amino acid sequence of SEQ ID NO: 28; the second polypeptide chain comprises the amino acid sequence of SEQ ID NO: 27 or an amino acid sequence that is at least 95% identical to the amino acid sequence of SEQ ID NO: 27; the third polypeptide chain comprises the amino acid sequence of SEQ ID NO: 25 or an amino acid sequence that is at least 95% identical to the amino acid sequence of SEQ ID NO: 25; and the fourth polypeptide chain comprises the amino acid sequence of SEQ ID NO: 26 or an amino acid sequence that is at least 95% identical to the amino acid sequence of SEQ ID NO: 26;

(e) the first polypeptide chain comprises the amino acid sequence of SEQ ID NO: 36 or an amino acid sequence that is at least 95% identical to the amino acid sequence of SEQ ID NO: 36; the second polypeptide chain comprises the amino acid sequence of SEQ ID NO: 35 or an amino acid sequence that is at least 95% identical to the amino acid sequence of SEQ ID NO: 35; the third polypeptide chain comprises the amino acid sequence of SEQ ID NO: 33 or an amino acid sequence that is at least 95% identical to the amino acid sequence of SEQ ID NO: 33; and the fourth polypeptide chain comprises the amino acid sequence of SEQ ID NO: 34 or an amino acid sequence that is at least 95% identical to the amino acid sequence of SEQ ID NO: 34;

(f) the first polypeptide chain comprises the amino acid sequence of SEQ ID NO: 44 or an amino acid sequence that is at least 95% identical to the amino acid sequence of SEQ ID NO: 44; the second polypeptide chain comprises the amino acid sequence of SEQ ID NO: 43 or an amino acid sequence that is at least 95% identical to the amino acid sequence of SEQ ID NO: 43; the third polypeptide chain comprises the amino acid sequence of SEQ ID NO: 41 or an amino acid sequence that is at least 95% identical to the amino acid sequence of SEQ ID NO: 41; and the fourth polypeptide chain comprises the amino acid sequence of SEQ ID NO: 42 or an amino acid sequence that is at least 95% identical to the amino acid sequence of SEQ ID NO: 42;

(g) the first polypeptide chain comprises the amino acid sequence of SEQ ID NO: 52 or an amino acid sequence that is at least 95% identical to the amino acid sequence of SEQ ID NO: 52; the second polypeptide chain comprises the amino acid sequence of SEQ ID NO: 51 or an amino acid sequence that is at least 95% identical to the amino acid sequence of SEQ ID NO: 51; the third polypeptide chain comprises the amino acid sequence of SEQ ID NO: 49 or an amino acid sequence that is at least 95% identical to the amino acid sequence of SEQ ID NO: 49; and the fourth polypeptide chain comprises the amino acid sequence of SEQ ID NO: 50 or an amino acid sequence that is at least 95% identical to the amino acid sequence of SEQ ID NO: 50;

(h) the first polypeptide chain comprises the amino acid sequence of SEQ ID NO: 60 or an amino acid sequence that is at least 95% identical to the amino acid sequence of SEQ ID NO: 60; the second polypeptide chain comprises the amino acid sequence of SEQ ID NO: 59 or an amino acid sequence that is at least 95% identical to the amino acid sequence of SEQ ID NO: 59; the third polypeptide chain comprises the amino acid sequence of SEQ ID NO: 57 or an amino acid sequence that is at least 95% identical to the amino acid sequence of SEQ ID NO: 57; and the fourth polypeptide chain comprises the amino acid sequence of SEQ ID NO: 58 or an amino acid sequence that is at least 95% identical to the amino acid sequence of SEQ ID NO: 58;

(i) the first polypeptide chain comprises the amino acid sequence of SEQ ID NO: 68 or an amino acid sequence that is at least 95% identical to the amino acid sequence of SEQ ID NO: 68; the second polypeptide chain comprises the amino acid sequence of SEQ ID NO: 67 or an amino acid sequence that is at least 95% identical to the amino acid sequence of SEQ ID NO: 67; the third polypeptide chain comprises the amino acid sequence of SEQ ID NO: 65 or an amino acid sequence that is at least 95% identical to the amino acid sequence of SEQ ID NO: 65; and the fourth polypeptide chain comprises the amino acid sequence of SEQ ID NO: 66 or an amino acid sequence that is at least 95% identical to the amino acid sequence of SEQ ID NO: 66;

(j) the first polypeptide chain comprises the amino acid sequence of SEQ ID NO: 76 or an amino acid sequence that is at least 95% identical to the amino acid sequence of SEQ ID NO: 76; the second polypeptide chain comprises the amino acid sequence of SEQ ID NO: 75 or an amino acid sequence that is at least 95% identical to the amino acid sequence of SEQ ID NO: 75; the third polypeptide chain comprises the amino acid sequence of SEQ ID NO: 73 or an amino acid sequence that is at least 95% identical to the amino acid sequence of SEQ ID NO: 73; and the fourth polypeptide chain comprises the amino acid sequence of SEQ ID NO: 74 or an amino acid sequence that is at least 95% identical to the amino acid sequence of SEQ ID NO: 74;

(k) the first polypeptide chain comprises the amino acid sequence of SEQ ID NO: 84 or an amino acid sequence that is at least 95% identical to the amino acid sequence of SEQ ID NO: 84; the second polypeptide chain comprises the amino acid sequence of SEQ ID NO: 83 or an amino acid sequence that is at least 95% identical to the amino acid sequence of SEQ ID NO: 83; the third polypeptide chain comprises the amino acid sequence of SEQ ID NO: 81 or an amino acid sequence that is at least 95% identical to the amino acid sequence of SEQ ID NO: 81; and the fourth polypeptide chain comprises the amino acid sequence of SEQ ID NO: 82 or an amino acid sequence that is at least 95% identical to the amino acid sequence of SEQ ID NO: 82;

(l) the first polypeptide chain comprises the amino acid sequence of SEQ ID NO: 92 or an amino acid sequence that is at least 95% identical to the amino acid sequence of SEQ ID NO:92; the second polypeptide chain comprises the amino acid sequence of SEQ ID NO: 91 or an amino acid sequence that is at least 95% identical to the amino acid sequence of SEQ ID NO: 91; the third polypeptide chain comprises the amino acid sequence of SEQ ID NO: 89 or an amino acid sequence that is at least 95% identical to the amino acid sequence of SEQ ID NO: 89; and the fourth polypeptide chain comprises the amino acid sequence of SEQ ID NO: 90 or an amino acid sequence that is at least 95% identical to the amino acid sequence of SEQ ID NO: 90;

(m) the first polypeptide chain comprises the amino acid sequence of SEQ ID NO: 100 or an amino acid sequence that is at least 95% identical to the amino acid sequence of SEQ ID NO: 100; the second polypeptide chain comprises the amino acid sequence of SEQ ID NO: 99 or an amino acid sequence that is at least 95% identical to the amino acid sequence of SEQ ID NO: 99; the third polypeptide chain comprises the amino acid sequence of SEQ ID NO: 97 or an amino acid sequence that is at least 95% identical to the amino acid sequence of SEQ ID NO: 97; and the fourth polypeptide chain comprises the amino acid sequence of SEQ ID NO: 98 or an amino acid sequence that is at least 95% identical to the amino acid sequence of SEQ ID NO: 98;

(n) the first polypeptide comprises the amino acid sequence of SEQ ID NO: 108 or an amino acid sequence that is at least 95% identical to the amino acid sequence of SEQ ID NO: 108; the second polypeptide chain comprises the amino acid sequence of SEQ ID NO: 107 or an amino acid sequence that is at least 95% identical to the amino acid sequence of SEQ ID NO: 107; the third polypeptide chain comprises the amino acid sequence of SEQ ID NO: 105 or an amino acid sequence that is at least 95% identical to the amino acid sequence of SEQ ID NO: 105; and the fourth polypeptide chain comprises the amino acid sequence of SEQ ID NO: 106 or an amino acid sequence that is at least 95% identical to the amino acid sequence of SEQ ID NO: 106;

(o) the first polypeptide chain comprises the amino acid sequence of SEQ ID NO: 116 or an amino acid sequence that is at least 95% identical to the amino acid sequence of SEQ ID NO: 116; the second polypeptide chain comprises the amino acid sequence of SEQ ID NO: 115 or an amino acid sequence that is at least 95% identical to the amino acid sequence of SEQ ID NO: 115; the third polypeptide chain comprises the amino acid sequence of SEQ ID NO: 113 or an amino acid sequence that is at least 95% identical to the amino acid sequence of SEQ ID NO: 113; and the fourth polypeptide chain comprises the amino acid sequence of SEQ ID NO: 114 or an amino acid sequence that is at least 95% identical to the amino acid sequence of SEQ ID NO: 114;

(p) the first polypeptide chain comprises the amino acid sequence of SEQ ID NO: 124 or an amino acid sequence that is at least 95% identical to the amino acid sequence of SEQ ID NO: 124; the second polypeptide chain comprises the amino acid sequence of SEQ ID NO: 123 or an amino acid sequence that is at least 95% identical to the amino acid sequence of SEQ ID NO: 123; the third polypeptide chain comprises the amino acid sequence of SEQ ID NO: 121 or an amino acid sequence that is at least 95% identical to the amino acid sequence of SEQ ID NO: 121; and the fourth polypeptide chain comprises the amino acid sequence of SEQ ID NO: 122 or an amino acid sequence that is at least 95% identical to the amino acid sequence of SEQ ID NO: 122;

(q) the first polypeptide chain comprises the amino acid sequence of SEQ ID NO: 132 or an amino acid sequence that is at least 95% identical to the amino acid sequence of SEQ ID NO: 132; the second polypeptide chain comprises the amino acid sequence of SEQ ID NO: 131 or an amino acid sequence that is at least 95% identical to the amino acid sequence of SEQ ID NO: 131; the third polypeptide chain comprises the amino acid sequence of SEQ ID NO: 129 or an amino acid sequence that is at least 95% identical to the amino acid sequence of SEQ ID NO: 129; and the fourth polypeptide chain comprises the amino acid sequence of SEQ ID NO: 130 or an amino acid sequence that is at least 95% identical to the amino acid sequence of SEQ ID NO: 130;

(r) the first polypeptide chain comprises the amino acid sequence of SEQ ID NO: 140 or an amino acid sequence that is at least 95% identical to the amino acid sequence of SEQ ID NO: 140; the second polypeptide chain comprises the amino acid sequence of SEQ ID NO: 139 or an amino acid sequence that is at least 95% identical to the amino acid sequence of SEQ ID NO: 139; the third polypeptide chain comprises the amino acid sequence of SEQ ID NO: 137 or an amino acid sequence that is at least 95% identical to the amino acid sequence of SEQ ID NO: 137; and the fourth polypeptide chain comprises the amino acid sequence of SEQ ID NO: 138 or an amino acid sequence that is at least 95% identical to the amino acid sequence of SEQ ID NO: 138;

(s) the first polypeptide chain comprises the amino acid sequence of SEQ ID NO: 148 or an amino acid sequence that is at least 95% identical to the amino acid sequence of SEQ ID NO: 148; the second polypeptide chain comprises the amino acid sequence of SEQ ID NO: 147 or an amino acid sequence that is at least 95% identical to the amino acid sequence of SEQ ID NO: 147; the third polypeptide chain comprises the amino acid sequence of SEQ ID NO: 145 or an amino acid sequence that is at least 95% identical to the amino acid sequence of SEQ ID NO: 145; and the fourth polypeptide chain comprises the amino acid sequence of SEQ ID NO: 146 or an amino acid sequence that is at least 95% identical to the amino acid sequence of SEQ ID NO: 146;

(t) the first polypeptide chain comprises the amino acid sequence of SEQ ID NO: 156 or an amino acid sequence that is at least 95% identical to the amino acid sequence of SEQ ID NO: 156; the second polypeptide chain comprises the amino acid sequence of SEQ ID NO: 155 or an amino acid sequence that is at least 95% identical to the amino acid sequence of SEQ ID NO: 155; the third polypeptide chain comprises the amino acid sequence of SEQ ID NO: 153 or an amino acid sequence that is at least 95% identical to the amino acid sequence of SEQ ID NO: 153; and the fourth polypeptide chain comprises the amino acid sequence of SEQ ID NO: 154 or an amino acid sequence that is at least 95% identical to the amino acid sequence of SEQ ID NO: 154;

(u) the first polypeptide chain comprises the amino acid sequence of SEQ ID NO: 164 or an amino acid sequence that is at least 95% identical to the amino acid sequence of SEQ ID NO: 164; the second polypeptide chain comprises the amino acid sequence of SEQ ID NO: 163 or an amino acid sequence that is at least 95% identical to the amino acid sequence of SEQ ID NO: 163; the third polypeptide chain comprises the amino acid sequence of SEQ ID NO: 161 or an amino acid sequence that is at least 95% identical to the amino acid sequence of SEQ ID NO: 161; and the fourth polypeptide chain comprises the amino acid sequence of SEQ ID NO: 162 or an amino acid sequence that is at least 95% identical to the amino acid sequence of SEQ ID NO: 162;

(v) the first polypeptide chain comprises the amino acid sequence of SEQ ID NO: 172 or an amino acid sequence that is at least 95% identical to the amino acid sequence of SEQ ID NO: 172; the second polypeptide chain comprises the amino acid sequence of SEQ ID NO: 171 or an amino acid sequence that is at least 95% identical to the amino acid sequence of SEQ ID NO: 171; the third polypeptide chain comprises the amino acid sequence of SEQ ID NO: 169 or an amino acid sequence that is at least 95% identical to the amino acid sequence of SEQ ID NO: 169; and the fourth polypeptide chain comprises the amino acid sequence of SEQ ID NO: 170 or an amino acid sequence that is at least 95% identical to the amino acid sequence of SEQ ID NO: 170;

(w) the first polypeptide chain comprises the amino acid sequence of SEQ ID NO: 180 or an amino acid sequence that is at least 95% identical to the amino acid sequence of SEQ ID NO: 180; the second polypeptide chain comprises the amino acid sequence of SEQ ID NO: 179 or an amino acid sequence that is at least 95% identical to the amino acid sequence of SEQ ID NO: 179; the third polypeptide chain comprises the amino acid sequence of SEQ ID NO: 177 or an amino acid sequence that is at least 95% identical to the amino acid sequence of SEQ ID NO: 177; and the fourth polypeptide chain comprises the amino acid sequence of SEQ ID NO: 178 or an amino acid sequence that is at least 95% identical to the amino acid sequence of SEQ ID NO: 178;

(x) the first polypeptide chain comprises the amino acid sequence of SEQ ID NO: 188 or an amino acid sequence that is at least 95% identical to the amino acid sequence of SEQ ID NO: 188; the second polypeptide chain comprises the amino acid sequence of SEQ ID NO: 187 or an amino acid sequence that is at least 95% identical to the amino acid sequence of SEQ ID NO: 187; the third polypeptide chain comprises the amino acid sequence of SEQ ID NO: 185 or an amino acid sequence that is at least 95% identical to the amino acid sequence of SEQ ID NO: 185; and the fourth polypeptide chain comprises the amino acid sequence of SEQ ID NO: 186 or an amino acid sequence that is at least 95% identical to the amino acid sequence of SEQ ID NO: 186;

(y) the first polypeptide chain comprises the amino acid sequence of SEQ ID NO: 196 or an amino acid sequence that is at least 95% identical to the amino acid sequence of SEQ ID NO: 196; the second polypeptide chain comprises the amino acid sequence of SEQ ID NO: 195 or an amino acid sequence that is at least 95% identical to the amino acid sequence of SEQ ID NO: 195; the third polypeptide chain comprises the amino acid sequence of SEQ ID NO: 193 or an amino acid sequence that is at least 95% identical to the amino acid sequence of SEQ ID NO: 193; and the fourth polypeptide chain comprises the amino acid sequence of SEQ ID NO: 194 or an amino acid sequence that is at least 95% identical to the amino acid sequence of SEQ ID NO: 194;

(z) the first polypeptide chain comprises the amino acid sequence of SEQ ID NO: 204 or an amino acid sequence that is at least 95% identical to the amino acid sequence of SEQ ID NO: 204; the second polypeptide chain comprises the amino acid sequence of SEQ ID NO: 203 or an amino acid sequence that is at least 95% identical to the amino acid sequence of SEQ ID NO: 203; the third polypeptide chain comprises the amino acid sequence of SEQ ID NO: 201 or an amino acid sequence that is at least 95% identical to the amino acid sequence of SEQ ID NO: 201; and the fourth polypeptide chain comprises the amino acid sequence of SEQ ID NO: 202 or an amino acid sequence that is at least 95% identical to the amino acid sequence of SEQ ID NO: 202;

(aa) the first polypeptide chain comprises the amino acid sequence of SEQ ID NO: 212 or an amino acid sequence that is at least 95% identical to the amino acid sequence of SEQ ID NO: 212; the second polypeptide chain comprises the amino acid sequence of SEQ ID NO: 211 or an amino acid sequence that is at least 95% identical to the amino acid sequence of SEQ ID NO: 211; the third polypeptide chain comprises the amino acid sequence of SEQ ID NO: 209 or an amino acid sequence that is at least 95% identical to the amino acid sequence of SEQ ID NO: 209; and the fourth polypeptide chain comprises the amino acid sequence of SEQ ID NO: 210 or an amino acid sequence that is at least 95% identical to the amino acid sequence of SEQ ID NO: 210;

(bb) the first polypeptide chain comprises the amino acid sequence of SEQ ID NO: 220 or an amino acid sequence that is at least 95% identical to the amino acid sequence of SEQ ID NO: 220; the second polypeptide chain comprises the amino acid sequence of SEQ ID NO: 219 or an amino acid sequence that is at least 95% identical to the amino acid sequence of SEQ ID NO: 219; the third polypeptide chain comprises the amino acid sequence of SEQ ID NO: 217 or an amino acid sequence that is at least 95% identical to the amino acid sequence of SEQ ID NO: 217; and the fourth polypeptide chain comprises the amino acid sequence of SEQ ID NO: 218 or an amino acid sequence that is at least 95% identical to the amino acid sequence of SEQ ID NO: 218;

(cc) the first polypeptide chain comprises the amino acid sequence of SEQ ID NO: 228 or an amino acid sequence that is at least 95% identical to the amino acid sequence of SEQ ID NO: 228; the second polypeptide chain comprises the amino acid sequence of SEQ ID NO: 227 or an amino acid sequence that is at least 95% identical to the amino acid sequence of SEQ ID NO: 227; the third polypeptide chain comprises the amino acid sequence of SEQ ID NO: 225 or an amino acid sequence that is at least 95% identical to the amino acid sequence of SEQ ID NO: 225; and the fourth polypeptide chain comprises the amino acid sequence of SEQ ID NO: 226 or an amino acid sequence that is at least 95% identical to the amino acid sequence of SEQ ID NO: 226;

(dd) the first polypeptide chain comprises the amino acid sequence of SEQ ID NO: 235 or an amino acid sequence that is at least 95% identical to the amino acid sequence of SEQ ID NO: 235; the second polypeptide chain comprises the amino acid sequence of SEQ ID NO: 234 or an amino acid sequence that is at least 95% identical to the amino acid sequence of SEQ ID NO: 234; the third polypeptide chain comprises the amino acid sequence of SEQ ID NO: 232 or an amino acid sequence that is at least 95% identical to the amino acid sequence of SEQ ID NO: 232; and the fourth polypeptide chain comprises the amino acid sequence of SEQ ID NO: 233 or an amino acid sequence that is at least 95% identical to the amino acid sequence of SEQ ID NO: 233; or (ee) first polypeptide chain comprises the amino acid sequence of SEQ ID NO: 243 or an amino acid sequence that is at least 95% identical to the amino acid sequence of SEQ ID NO: 243; the second polypeptide chain comprises the amino acid sequence of SEQ ID NO: 242 or an amino acid sequence that is at least 95% identical to the amino acid sequence of SEQ ID NO: 242; the third polypeptide chain comprises the amino acid sequence of SEQ ID NO: 240 or an amino acid sequence that is at least 95% identical to the amino acid sequence of SEQ ID NO: 240; and the fourth polypeptide chain comprises the amino acid sequence of SEQ ID NO: 241 or an amino acid sequence that is at least 95% identical to the amino acid sequence of SEQ ID NO: 241.

In one embodiment, the disclosure provides a binding protein comprising four polypeptide chains that form three antigen binding sites that specifically bind one or more HIV target proteins and one or more T cell target proteins, wherein a first polypeptide chain comprises a structure represented by the formula:

$$V_{L2}\text{-}L_1\text{-}V_{L1}\text{-}L_2\text{-}C_L \qquad [I];$$

a second polypeptide chain comprises a structure represented by the formula:

$$V_{H1}\text{-}L_3\text{-}V_{H2}\text{-}L_4\text{-}C_{H1} \qquad [II];$$

a third polypeptide chain comprises a structure represented by the formula:

$$V_{H3}\text{-}C_{H1} \qquad [III];$$

and a fourth polypeptide chain comprises a structure represented by the formula:

$$V_{L3}\text{-}C_L \qquad [IV];$$

wherein
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$, and $L_4$ are amino acid linkers;
and wherein the polypeptide of formula I and the polypeptide of formula II form a cross-over light chain-heavy chain pair.

In some embodiments, the second polypeptide chain further comprises an Fc region linked to $C_{H1}$, the Fc region comprising an immunoglobulin hinge region and $C_{H2}$ and $C_{H3}$ immunoglobulin heavy chain constant domains. In some embodiments, the third polypeptide chain further comprises an Fc region linked to $C_{H1}$, the Fc region comprising an immunoglobulin hinge region and $C_{H2}$ and $C_{H3}$ immunoglobulin heavy chain constant domains. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 354 and 366 of human IgG1 according to EU Index, wherein the amino acid substitutions are S354C and T366W; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 349, 366, 368, and 407 of human IgG1 according to EU Index, wherein the amino acid substitutions are Y349C, T366S, L368A, and Y407V. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 349, 366, 368, and 407 of human IgG1 according to EU Index, wherein the amino acid substitutions are Y349C, T366S, L368A, and Y407V; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 354 and 366 of human IgG1 according to EU Index, wherein the amino acid substitutions are S354C and T366W. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains; wherein the first and second Fc regions comprise amino acid substitutions at positions corresponding to positions 428 and 434 of human IgG1 according to EU Index, wherein the amino acid substitutions are M428L and N434S.

In one embodiment, the disclosure provides a binding protein comprising four polypeptide chains that form three antigen binding sites that specifically bind one or more HIV target proteins and one or more T cell target proteins, wherein a first polypeptide chain comprises a structure represented by the formula:

$$V_{L2}\text{-}L_1\text{-}V_{L1}\text{-}L_2\text{-}C_L \qquad [I];$$

a second polypeptide chain comprises a structure represented by the formula:

$$V_{H1}\text{-}L_3\text{-}V_{H2}\text{-}L_4\text{-}C_{H1}\text{-}\text{hinge}\text{-}C_{H2}\text{-}C_{H3} \qquad [II];$$

a third polypeptide chain comprises a structure represented by the formula:

$$V_{H3}\text{-}C_{H1}\text{-}\text{hinge}\text{-}C_{H2}\text{-}C_{H3} \qquad [III];$$

and a fourth polypeptide chain comprises a structure represented by the formula:

$$V_{L3}\text{-}C_L \qquad [IV];$$

wherein
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;

$V_{H3}$ is a third immunoglobulin heavy chain variable domain;

$C_L$ is an immunoglobulin light chain constant domain;

$C_{H1}$ is the immunoglobulin $C_{H1}$ heavy chain constant domain;

$C_{H2}$ is an immunoglobulin $C_{H2}$ heavy chain constant domain;

$C_{H3}$ is an immunoglobulin $C_{H3}$ heavy chain constant domain;

hinge is an immunoglobulin hinge region connecting the $C_{H1}$ and $C_{H2}$ domains; and $L_1$, $L_2$, $L_3$, and $L_4$ are amino acid linkers;

and wherein the polypeptide of formula I and the polypeptide of formula II form a cross-over light chain-heavy chain pair.

In some embodiments, the $C_{H3}$ domain of the second polypeptide chain comprises amino acid substitutions at positions corresponding to positions 354 and 366 of human IgG1 according to EU Index, wherein the amino acid substitutions are S354C and T366W; and wherein the $C_{H3}$ domain of the third polypeptide chain comprises amino acid substitutions at positions corresponding to positions 349, 366, 368, and 407 of human IgG1 according to EU Index, wherein the amino acid substitutions are Y349C, T366S, L368A, and Y407V. In some embodiments, the $C_{H3}$ domain of the second polypeptide chain comprises amino acid substitutions at positions corresponding to positions 349, 366, 368, and 407 of human IgG1 according to EU Index, wherein the amino acid substitutions are Y349C, T366S, L368A, and Y407V; and wherein the $C_{H3}$ domain of the third polypeptide chain comprises amino acid substitutions at positions corresponding to positions 354 and 366 of human IgG1 according to EU Index, wherein the amino acid substitutions are S354C and T366W. In some embodiments, the $C_{H3}$ domains of the second and the third polypeptide chains both comprise amino acid substitutions at positions corresponding to positions 428 and 434 of human IgG1 according to EU Index, wherein the amino acid substitutions are M428L and N434S.

In some embodiments, the one or more HIV target proteins are selected from the group consisting of glycoprotein 120, glycoprotein 41 and glycoprotein 160. In some embodiments, the one or more T cell target proteins are CD3 or CD28. In some embodiments, the binding protein is trispecific and capable of specifically binding an HIV target protein and two different epitopes on a single T cell target protein. In some embodiments, the binding protein is trispecific and capable of specifically binding an HIV target protein and two different T cell target proteins. In some embodiments, the binding protein is trispecific and capable of specifically binding a T cell target protein and two different epitopes on a single HIV target protein. In some embodiments, the binding protein is trispecific and capable of specifically binding a T cell target protein and two different HIV target proteins. In some embodiments, the first and second polypeptide chains form two antigen binding sites that specifically target two T cell target proteins, and the third and fourth polypeptide chains form an antigen binding site that specifically binds an HIV target protein. In some embodiments, $V_{L1}$ comprises a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; a sequence as set forth in SEQ ID NOs: 278, 279, and 280, respectively; a sequence as set forth in SEQ ID NOs: 488, 489, and 490, respectively; a sequence as set forth in SEQ ID NOs: 491, 492, and 493, respectively; or a sequence as set forth in SEQ ID NOs: 494, 495, and 496, respectively. In some embodiments, $V_{L1}$ comprises a CDR-L1, CDR-L2, and CDR-L3 of a light chain variable domain comprising a sequence selected from the group consisting of SEQ ID NOs: 512, 513, 514, 515, 516, 517, 518, 519, 520, 521, 522, 523, and 524. In some embodiments, $V_{L1}$ comprises a light chain variable domain comprising a sequence selected from the group consisting of SEQ ID NOs: 512, 513, 514, 515, 516, 517, 518, 519, 520, 521, 522, 523, and 524. In some embodiments, $V_{L2}$ comprises a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; a sequence as set forth in SEQ ID NOs: 278, 279, and 280, respectively; a sequence as set forth in SEQ ID NOs: 488, 489, and 490, respectively; a sequence as set forth in SEQ ID NOs: 491, 492, and 493, respectively; or a sequence as set forth in SEQ ID NOs: 494, 495, and 496, respectively. In some embodiments, $V_{L2}$ comprises a CDR-L1, CDR-L2, and CDR-L3 of a light chain variable domain comprising a sequence selected from the group consisting of SEQ ID NOs: 512, 513, 514, 515, 516, 517, 518, 519, 520, 521, 522, 523, and 524. In some embodiments, $V_{L2}$ comprises a light chain variable domain comprising a sequence selected from the group consisting of SEQ ID NOs: 512, 513, 514, 515, 516, 517, 518, 519, 520, 521, 522, 523, and 524. In some embodiments, $V_{L3}$ comprises a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; a sequence as set forth in SEQ ID NOs: 278, 279, and 280, respectively; a sequence as set forth in SEQ ID NOs: 488, 489, and 490, respectively; a sequence as set forth in SEQ ID NOs: 491, 492, and 493, respectively; or a sequence as set forth in SEQ ID NOs: 494, 495, and 496, respectively. In some embodiments, $V_{L3}$ comprises a CDR-L1, CDR-L2, and CDR-L3 of a light chain variable domain comprising a sequence selected from the group consisting of SEQ ID NOs: 512, 513, 514, 515, 516, 517, 518, 519, 520, 521, 522, 523, and 524. In some embodiments, $V_{L3}$ comprises a light chain variable domain comprising a sequence selected from the group consisting of SEQ ID NOs: 512, 513, 514, 515, 516, 517, 518, 519, 520, 521, 522, 523, and 524. In some embodiments, $V_{H1}$ comprises a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; a sequence as set forth in SEQ ID NOs: 499, 261, and 262, respectively; a sequence as set forth in SEQ ID NOs: 479, 480, and 481, respectively; a sequence as set forth in SEQ ID NOs: 482, 483, and 484, respectively; or a sequence as set forth in SEQ ID NOs: 485, 486, and 487, respectively. In some embodiments, $V_{H1}$ comprises a CDR-H1, CDR-H2, and CDR-H3 of a heavy chain variable domain comprising a sequence selected from the group consisting of SEQ ID NOs: 502, 503, 504, 505, 506, 507, 508, 509, 510, and 511. In some embodiments, $V_{H1}$ comprises a heavy chain variable domain comprising a sequence selected from the group consisting of SEQ ID NOs: 502, 503, 504, 505, 506, 507, 508, 509, 510, and 511. In some embodiments, $V_{H2}$ comprises a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; a sequence as set forth in SEQ ID NOs: 499, 261, and 262, respectively; a sequence as set forth in SEQ ID NOs: 479, 480, and 481, respectively; a sequence as set forth in SEQ ID NOs: 482, 483, and 484, respectively; or a sequence as set forth in SEQ ID NOs: 485, 486, and 487, respectively. In some embodiments, $V_{H2}$ comprises a CDR-H1, CDR-H2, and CDR-H3 of a heavy chain variable domain comprising a sequence selected from the group consisting of SEQ ID NOs: 502, 503, 504, 505, 506, 507, 508, 509, 510, and 511. In some embodiments, $V_{H2}$ comprises a heavy chain variable domain comprising a sequence selected from the group consisting of SEQ ID NOs: 502, 503, 504, 505, 506, 507, 508, 509, 510, and 511. In some embodiments, $V_{H3}$ comprises a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; a sequence as set forth in SEQ ID NOs: 499, 261, and 262, respectively; a sequence as set forth in SEQ ID NOs: 479, 480, and 481, respectively; a sequence as set forth in SEQ ID NOs: 482, 483, and 484, respectively; or a sequence as set forth in SEQ ID NOs: 485, 486, and 487, respectively. In some embodiments, $V_{H3}$ comprises a CDR-H1, CDR-H2, and CDR-H3 of a heavy chain variable domain comprising a sequence selected from the group consisting of SEQ ID NOs: 502, 503, 504, 505, 506, 507, 508, 509, 510, and 511. In some embodiments, $V_{H3}$ comprises a heavy chain variable domain comprising a sequence selected from the group consisting of SEQ ID NOs: 502, 503, 504, 505, 506, 507, 508, 509, 510, and 511. In some embodiments, $V_{L1}$ comprises a CDR-L1 comprising the sequence of SEQ ID NO: 488, a CDR-L2 comprising the sequence of SEQ ID NO: 489, and a CDR-L3 comprising the sequence of SEQ ID NO: 490; $V_{L2}$ comprises a CDR-L1 comprising the sequence of SEQ ID NO: 494, a CDR-L2 comprising the sequence of SEQ ID NO: 495, and a CDR-L3 comprising the sequence of SEQ ID NO: 496; $V_{L3}$ comprises a CDR-L1 comprising the sequence of SEQ ID NO: 269, a CDR-L2 comprising the sequence of SEQ ID NO: 270, and a CDR-L3 comprising the sequence of SEQ ID NO: 271; $V_{H1}$ comprises a CDR-H1 comprising the sequence of SEQ ID NO: 479, a CDR-H2 comprising the sequence of SEQ ID NO: 480, and a CDR-H3 comprising the sequence of SEQ ID NO: 481; $V_{H2}$ comprises a CDR-H1 comprising the sequence of SEQ ID NO: 485, a CDR-H2 comprising the sequence of SEQ ID NO: 486, and a CDR-H3 comprising the sequence of SEQ ID NO: 487; and $V_{H3}$ comprises a CDR-H1 comprising the sequence of SEQ ID NO: 251, a CDR-H2 comprising the sequence of SEQ ID NO: 252, and a CDR-H3 comprising the sequence of SEQ ID NO: 253. In some embodiments, $V_{L1}$ comprises a CDR-L1, CDR-L2, and CDR-L3 of a light chain variable domain comprising the light chain variable domain sequence of SEQ ID NO: 522; $V_{L2}$ comprises a CDR-L1, CDR-L2, and CDR-L3 of a light chain variable domain comprising the light chain variable domain sequence of SEQ ID NO: 524; $V_{L3}$ comprises a CDR-L1, CDR-L2, and CDR-L3 of a light chain variable domain comprising the light chain variable domain sequence of SEQ ID NO: 513; $V_{H1}$ comprises a CDR-H1, CDR-H2, and CDR-H3 of a heavy chain variable domain comprising the heavy chain variable domain sequence of SEQ ID NO: 509; $V_{H2}$ comprises a CDR-H1, CDR-H2, and CDR-H3 of a heavy chain variable domain comprising the heavy chain variable domain sequence of SEQ ID NO: 511; and $V_{H3}$ comprises a CDR-H1, CDR-H2, and CDR-H3 of a heavy chain variable domain comprising the heavy chain variable domain sequence of SEQ ID NO: 503. In some embodiments, $V_{L1}$ comprises a light chain variable domain comprising the sequence of SEQ ID NO: 522; $V_{L2}$ comprises a light chain variable domain comprising the sequence of SEQ ID NO: 524; $V_{L3}$ comprises a light chain variable domain comprising the sequence of SEQ ID NO: 513; $V_{H1}$ comprises a heavy chain variable domain comprising the sequence of SEQ ID NO: 509; $V_{H2}$ comprises a heavy chain variable domain comprising the sequence of SEQ ID NO: 511; and $V_{H3}$ comprises a heavy chain variable domain comprising the sequence of SEQ ID NO: 503. In some embodiments, $V_{L1}$ comprises a CDR-L1 comprising the sequence of SEQ ID NO: 494, a CDR-L2 comprising the sequence of SEQ ID NO: 495, and a CDR-L3 comprising the sequence of SEQ ID NO: 496; $V_{L2}$ comprises a CDR-L1 comprising the sequence of SEQ ID NO: 488, a CDR-L2 comprising the sequence of SEQ ID NO: 489, and a CDR-L3 comprising the sequence of SEQ ID NO: 490; $V_{L3}$ comprises a CDR-L1 comprising the sequence of SEQ ID NO: 269, a CDR-L2 comprising the sequence of SEQ ID NO: 270, and a CDR-L3 comprising the sequence of SEQ ID NO: 271; $V_{H1}$ comprises a CDR-H1 comprising the sequence of SEQ ID NO: 485, a CDR-H2 comprising the sequence of SEQ ID NO: 486, and a CDR-H3 comprising the sequence of SEQ ID NO: 487; $V_{H2}$ comprises a CDR-H1 comprising the sequence of SEQ ID NO: 479, a CDR-H2 comprising the sequence of SEQ ID NO: 480, and a CDR-H3 comprising the sequence of SEQ ID NO: 481; and $V_{H3}$ comprises a CDR-H1 comprising the sequence of SEQ ID NO: 251, a CDR-H2 comprising the sequence of SEQ ID NO: 252, and a CDR-H3 comprising the sequence of SEQ ID NO: 253. In some embodiments, $V_{L1}$ comprises a CDR-L1, CDR-L2, and CDR-L3 of a light chain variable domain comprising the light chain variable domain sequence of SEQ ID NO: 524; $V_{L2}$ comprises a CDR-L1, CDR-L2, and CDR-L3 of a light chain variable domain comprising the light chain variable domain sequence of SEQ ID NO: 522; $V_{L3}$ comprises a CDR-L1, CDR-L2, and CDR-L3 of a light chain variable domain comprising the light chain variable domain sequence of SEQ ID NO: 513; $V_{H1}$ comprises a CDR-H1, CDR-H2, and CDR-H3 of a heavy chain variable domain comprising the heavy chain variable domain sequence of SEQ ID NO: 511; $V_{H2}$ comprises a CDR-H1, CDR-H2, and CDR-H3 of a heavy chain variable domain comprising the heavy chain variable domain sequence of SEQ ID NO: 509; and $V_{H3}$ comprises a CDR-H1, CDR-H2, and CDR-H3 of a heavy chain variable domain comprising the heavy chain variable domain sequence of SEQ ID NO: 503. In some embodiments, $V_{L1}$ comprises a light chain variable domain comprising the sequence of SEQ ID NO: 524; $V_{L2}$ comprises a light chain variable domain comprising the sequence of SEQ ID NO: 522; $V_{L3}$ comprises a light chain variable domain comprising the sequence of SEQ ID NO: 513; $V_{H1}$ comprises a heavy chain variable domain comprising the sequence of SEQ ID NO: 511; $V_{H2}$ comprises a heavy chain variable domain comprising the sequence of SEQ ID NO: 509; and $V_{H3}$ comprises a heavy chain variable domain comprising the sequence of SEQ ID NO: 503. In some embodiments, at least one of $L_1$, $L_2$, $L_3$, or $L_4$ is independently 0 amino acids in length. In some embodiments, $L_1$, $L_2$, $L_3$, or $L_4$ are each independently at least one amino acid in length. In some embodiments, $L_1$ is Gly-Gln-Pro-Lys-Ala-Ala-Pro (SEQ ID NO: 299).

In one embodiment, the disclosure provides a binding protein comprising four polypeptide chains that form three antigen binding sites, wherein a first polypeptide chain comprises a structure represented by the formula:

$$V_{L2}\text{-}L_1\text{-}V_{L1}\text{-}L_2\text{-}C_L \qquad [\text{I}]$$

and a second polypeptide chain comprises a structure represented by the formula:

$$V_{H1}\text{-}L_3\text{-}V_{H2}\text{-}L_4\text{-}C_{H1} \qquad [\text{II}]$$

and a third polypeptide chain comprises a structure represented by the formula:

$$V_{H3}\text{-}C_{H1} \qquad [\text{III}]$$

and a fourth polypeptide chain comprises a structure represented by the formula:

$$V_{L3}\text{-}C_L \qquad [\text{IV}]$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$, and $L_4$ are amino acid linkers;
wherein the polypeptide of formula I and the polypeptide of formula II form a cross-over light chain-heavy chain pair; wherein:

(a) $V_{L1}$, $V_{L2}$ and $V_{L3}$ are each independently a variable domain derived from an amino acid sequence as set forth in any one of SEQ ID NOs: 303, 305, 311, 313, 319, 321, 327, 329, 335, 337, 343, 345, 351, 353, 359, 361, 367, 369, 375, 377, 383, 385, 391, 393, 399, 401, 407, 409, 415, 417, 423, 425, 431, 433, 439, 441, 447, 449, 455, 457, 463, 465, 471, 473; or (b) $V_{L1}$, $V_{L2}$ and $V_{L3}$ each independently comprise light chain complementarity determining regions of a variable domain comprising an amino acid sequence as set forth in any one of SEQ ID NOs: 266-271, 275-277, 488-496; and wherein:

(a) $V_{H1}$, $V_{H2}$, and $V_{H3}$ are each independently a variable domain derived from an amino acid sequence as set forth in any one of SEQ ID NOs: 302, 304, 310, 312, 318, 320, 326, 328, 334, 336, 342, 344, 350, 352, 358, 360, 366, 368, 374, 376, 382, 384, 390, 392, 398, 400, 406, 408, 414, 416, 422, 424, 430, 432, 438, 440, 446, 448, 454, 456, 462, 464, 470, 472; or (b) $V_{H1}$, $V_{H2}$, and $V_{H3}$ each independently comprise heavy chain complementarity determining regions of a variable domain comprising an amino acid sequence as set forth in any one of SEQ ID NOs: 248-253, 257-259, 479-487.

In some embodiments, the second polypeptide chain further comprises an Fc region linked to $C_{H1}$, the Fc region comprising an immunoglobulin hinge region and $C_{H2}$ and $C_{H3}$ immunoglobulin heavy chain constant domains. In some embodiments, the third polypeptide chain further comprises an Fc region linked to $C_{H1}$, the Fc region comprising an immunoglobulin hinge region and $C_{H2}$ and $C_{H3}$ immunoglobulin heavy chain constant domains. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 354 and 366 of human IgG1 according to EU Index, wherein the amino acid substitutions are S354C and T366W; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 349, 366, 368, and 407 of human IgG1 according to EU Index, wherein the amino acid substitutions are Y349C, T366S, L368A, and Y407V. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 349, 366, 368, and 407 of human IgG1 according to EU Index, wherein the amino acid substitutions are Y349C, T366S, L368A, and Y407V; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 354 and 366 of human IgG1 according to EU Index, wherein the amino acid substitutions are S354C and T366W. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains; wherein the first and second Fc regions comprise amino acid substitutions at positions corresponding to positions 428 and 434 of human IgG1 according to EU Index, wherein the amino acid substitutions are M428L and N434S.

In one embodiment, the disclosure provides a binding protein comprising four polypeptide chains that form three antigen binding sites, wherein a first polypeptide chain comprises a structure represented by the formula:

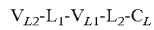

$$V_{L2}\text{-}L_1\text{-}V_{L1}\text{-}L_2\text{-}C_L \qquad [\text{I}]$$

and a second polypeptide chain comprises a structure represented by the formula:

$$V_{H1}\text{-}L_3\text{-}V_{H2}\text{-}L_4\text{-}C_{H1}\text{-}\text{hinge-}C_{H2}\text{-}C_{H3} \quad [\text{II}]$$

and a third polypeptide chain comprises a structure represented by the formula:

$$V_{H3}\text{-}C_{H1}\text{-}\text{hinge-}C_{H2}\text{-}C_{H3} \quad [\text{III}]$$

and a fourth polypeptide chain comprises a structure represented by the formula:

$$V_{L3}\text{-}C_L \quad [\text{IV}]$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain;
$C_{H2}$ is an immunoglobulin $C_{H2}$ heavy chain constant domain;
$C_{H3}$ is an immunoglobulin $C_{H3}$ heavy chain constant domain;
hinge is an immunoglobulin hinge region connecting the $C_{H1}$ and $C_{H2}$ domains; and
$L_1$, $L_2$, $L_3$, and $L_4$ are amino acid linkers;
wherein the polypeptide of formula I and the polypeptide of formula II form a cross-over light chain-heavy chain pair;
wherein:
(a) $V_{L1}$, $V_{L2}$ and $V_{L3}$ are each independently a variable domain derived from an amino acid sequence as set forth in any one of SEQ ID NOs: 303, 305, 311, 313, 319, 321, 327, 329, 335, 337, 343, 345, 351, 353, 359, 361, 367, 369, 375, 377, 383, 385, 391, 393, 399, 401, 407, 409, 415, 417, 423, 425, 431, 433, 439, 441, 447, 449, 455, 457, 463, 465, 471, 473; or
(b) $V_{L1}$, $V_{L2}$ and $V_{L3}$ each independently comprise light chain complementarity determining regions of a variable domain comprising an amino acid sequence as set forth in any one of SEQ ID NOs: 266-271, 275-277, 488-496; and wherein:
(a) $V_{H1}$, $V_{H2}$, and $V_{H3}$ are each independently a variable domain derived from an amino acid sequence as set forth in any one of SEQ ID NOs: 302, 304, 310, 312, 318, 320, 326, 328, 334, 336, 342, 344, 350, 352, 358, 360, 366, 368, 374, 376, 382, 384, 390, 392, 398, 400, 406, 408, 414, 416, 422, 424, 430, 432, 438, 440, 446, 448, 454, 456, 462, 464, 470, 472; or
(b) $V_{H1}$, $V_{H2}$, and $V_{H3}$ each independently comprise heavy chain complementarity determining regions of a variable domain comprising an amino acid sequence as set forth in any one of SEQ ID NOs: 248-253, 257-259, 479-487.

In some embodiments, the $C_{H3}$ domain of the second polypeptide chain comprises amino acid substitutions at positions corresponding to positions 354 and 366 of human IgG1 according to EU Index, wherein the amino acid substitutions are S354C and T366W; and wherein the $C_{H3}$ domain of the third polypeptide chain comprises amino acid substitutions at positions corresponding to positions 349, 366, 368, and 407 of human IgG1 according to EU Index, wherein the amino acid substitutions are Y349C, T366S, L368A, and Y407V. In some embodiments, the $C_{H3}$ domain of the second polypeptide chain comprises amino acid substitutions at positions corresponding to positions 349, 366, 368, and 407 of human IgG1 according to EU Index, wherein the amino acid substitutions are Y349C, T366S, L368A, and Y407V; and wherein the $C_{H3}$ domain of the third polypeptide chain comprises amino acid substitutions at positions corresponding to positions 354 and 366 of human IgG1 according to EU Index, wherein the amino acid substitutions are S354C and T366W. In some embodiments, the $C_{H3}$ domains of the second and the third polypeptide chains both comprise amino acid substitutions at positions corresponding to positions 428 and 434 of human IgG1 according to EU Index, wherein the amino acid substitutions are M428L and N434S.

In some embodiments, at least one of $L_1$, $L_2$, $L_3$, or $L_4$ is independently 0 amino acids in length. In some embodiments, $L_1$, $L_2$, $L_3$, or $L_4$ are each independently at least one amino acid in length. In some embodiments, $L_1$ is Gly-Gln-Pro-Lys-Ala-Ala-Pro (SEQ ID NO: 299).

In one embodiment, the disclosure provides a binding protein comprising four polypeptide chains that form three antigen binding sites, wherein a first polypeptide chain has a structure represented by the formula:

$$V_{L2}\text{-}L_1\text{-}V_{L1}\text{-}L_2\text{-}C_L \quad [\text{I}]$$

and a second polypeptide chain has a structure represented by the formula:

$$V_{H1}\text{-}L_3\text{-}V_{H2}\text{-}L_4\text{-}C_{H1} \quad [\text{II}]$$

and a third polypeptide chain has a structure represented by the formula:

$$V_{H3}\text{-}C_{H1} \quad [\text{III}]$$

and a fourth polypeptide chain has a structure represented by the formula:

$$V_{L3}\text{-}C_L \quad [\text{IV}]$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$, and $L_4$ are amino acid linkers;
wherein the polypeptide of formula I and the polypeptide of formula II form a cross-over light chain-heavy chain pair;
wherein:
(a) $V_{L1}$, $V_{L2}$ and $V_{L3}$ are each independently a variable domain derived from an amino acid sequence as set forth in any one of SEQ ID NOs: 303, 305, 311, 313, 319, 321, 327, 329, 335, 337, 343, 345, 351, 353, 359, 361, 367, 369, 375, 377, 383, 385, 391, 393, 399, 401, 407, 409, 415, 417, 423, 425, 431, 433, 439, 441, 447, 449, 455, 457, 463, 465, 471, 473; or
(b) $V_{L1}$, $V_{L2}$ and $V_{L3}$ each independently comprise light chain complementarity determining regions of a variable domain comprising an amino acid sequence as set forth in any one of SEQ ID NOs: 266-271, 275-277, 488-496; and wherein:

(a) $V_{H1}$, $V_{H2}$, and $V_{H3}$ are each independently a variable domain derived from an amino acid sequence as set forth in any one of SEQ ID NOs: 302, 304, 310, 312, 318, 320, 326, 328, 334, 336, 342, 344, 350, 352, 358, 360, 366, 368, 374, 376, 382, 384, 390, 392, 398, 400, 406, 408, 414, 416, 422, 424, 430, 432, 438, 440, 446, 448, 454, 456, 462, 464, 470, 472; or (b) $V_{H1}$, $V_{H2}$, and $V_{H3}$ each independently comprise heavy chain complementarity determining regions of a variable domain comprising an amino acid sequence as set forth in any one of SEQ ID NOs: 248-253, 257-259, 479-487.

In another embodiment, the disclosure provides a binding protein comprising a first polypeptide chain, a second polypeptide chain, a third polypeptide chain and a fourth polypeptide chain wherein:

(a) the first polypeptide chain comprises the amino acid sequence of SEQ ID NO: 305 or an amino acid sequence that is at least 95% identical to the amino acid sequence of SEQ ID NO: 305; the second polypeptide chain comprises the amino acid sequence of SEQ ID NO: 304 or an amino acid sequence that is at least 95% identical to the amino acid sequence of SEQ ID NO: 304; the third polypeptide chain comprises the amino acid sequence of SEQ ID NO: 302 or an amino acid sequence that is at least 95% identical to the amino acid sequence of SEQ ID NO: 302; and the fourth polypeptide chain comprises the amino acid sequence of SEQ ID NO: 303 or an amino acid sequence that is at least 95% identical to the amino acid sequence of SEQ ID NO: 303;

(b) the first polypeptide chain comprises the amino acid sequence of SEQ ID NO: 313 or an amino acid sequence that is at least 95% identical to the amino acid sequence of SEQ ID NO: 313; the second polypeptide chain comprises the amino acid sequence of SEQ ID NO: 312 or an amino acid sequence that is at least 95% identical to the amino acid sequence of SEQ ID NO: 312; the third polypeptide chain comprises the amino acid sequence of SEQ ID NO: 310 or an amino acid sequence that is at least 95% identical to the amino acid sequence of SEQ ID NO: 310; and the fourth polypeptide chain comprises the amino acid sequence of SEQ ID NO: 311 or an amino acid sequence that is at least 95% identical to the amino acid sequence of SEQ ID NO: 311;

(c) the first polypeptide chain comprises the amino acid sequence of SEQ ID NO: 321 or an amino acid sequence that is at least 95% identical to the amino acid sequence of SEQ ID NO: 321; the second polypeptide chain comprises the amino acid sequence of SEQ ID NO: 320 or an amino acid sequence that is at least 95% identical to the amino acid sequence of SEQ ID NO: 320; the third polypeptide chain comprises the amino acid sequence of SEQ ID NO: 318 or an amino acid sequence that is at least 95% identical to the amino acid sequence of SEQ ID NO: 318; and the fourth polypeptide chain comprises the amino acid sequence of SEQ ID NO: 319 or an amino acid sequence that is at least 95% identical to the amino acid sequence of SEQ ID NO: 319;

(d) the first polypeptide chain comprises the amino acid sequence of SEQ ID NO: 329 or an amino acid sequence that is at least 95% identical to the amino acid sequence of SEQ ID NO: 329; the second polypeptide chain comprises the amino acid sequence of SEQ ID NO: 328 or an amino acid sequence that is at least 95% identical to the amino acid sequence of SEQ ID NO: 328; the third polypeptide chain comprises the amino acid sequence of SEQ ID NO: 326 or an amino acid sequence that is at least 95% identical to the amino acid sequence of SEQ ID NO: 326; and the fourth polypeptide chain comprises the amino acid sequence of SEQ ID NO: 327 or an amino acid sequence that is at least 95% identical to the amino acid sequence of SEQ ID NO: 327;

(e) the first polypeptide chain comprises the amino acid sequence of SEQ ID NO: 337 or an amino acid sequence that is at least 95% identical to the amino acid sequence of SEQ ID NO: 337; the second polypeptide chain comprises the amino acid sequence of SEQ ID NO: 336 or an amino acid sequence that is at least 95% identical to the amino acid sequence of SEQ ID NO: 336; the third polypeptide chain comprises the amino acid sequence of SEQ ID NO: 334 or an amino acid sequence that is at least 95% identical to the amino acid sequence of SEQ ID NO: 334; and the fourth polypeptide chain comprises the amino acid sequence of SEQ ID NO: 335 or an amino acid sequence that is at least 95% identical to the amino acid sequence of SEQ ID NO: 335;

(f) the first polypeptide chain comprises the amino acid sequence of SEQ ID NO: 345 or an amino acid sequence that is at least 95% identical to the amino acid sequence of SEQ ID NO: 345; the second polypeptide chain comprises the amino acid sequence of SEQ ID NO: 344 or an amino acid sequence that is at least 95% identical to the amino acid sequence of SEQ ID NO: 344; the third polypeptide chain comprises the amino acid sequence of SEQ ID NO: 342 or an amino acid sequence that is at least 95% identical to the amino acid sequence of SEQ ID NO: 342; and the fourth polypeptide chain comprises the amino acid sequence of SEQ ID NO: 343 or an amino acid sequence that is at least 95% identical to the amino acid sequence of SEQ ID NO: 343;

(g) the first polypeptide chain comprises the amino acid sequence of SEQ ID NO: 353 or an amino acid sequence that is at least 95% identical to the amino acid sequence of SEQ ID NO: 353; the second polypeptide chain comprises the amino acid sequence of SEQ ID NO: 352 or an amino acid sequence that is at least 95% identical to the amino acid sequence of SEQ ID NO:352; the third polypeptide chain comprises the amino acid sequence of SEQ ID NO: 350 or an amino acid sequence that is at least 95% identical to the amino acid sequence of SEQ ID NO: 350; and the fourth polypeptide chain comprises the amino acid sequence of SEQ ID NO: 351 or an amino acid sequence that is at least 95% identical to the amino acid sequence of SEQ ID NO: 351;

(h) the first polypeptide chain comprises the amino acid sequence of SEQ ID NO: 361 or an amino acid sequence that is at least 95% identical to the amino acid sequence of SEQ ID NO: 361; the second polypeptide chain comprises the amino acid sequence of SEQ ID NO: 360 or an amino acid sequence that is at least 95% identical to the amino acid sequence of SEQ ID NO: 360; the third polypeptide chain comprises the amino acid sequence of SEQ ID NO: 358 or an amino acid sequence that is at least 95% identical to the amino acid sequence of SEQ ID NO: 358; and the fourth polypeptide chain comprises the amino acid sequence of SEQ ID NO: 359 or an amino acid sequence that is at least 95% identical to the amino acid sequence of SEQ ID NO: 359;

(i) the first polypeptide chain comprises the amino acid sequence of SEQ ID NO: 369 or an amino acid sequence that is at least 95% identical to the amino acid sequence of SEQ ID NO: 369; the second polypeptide chain comprises the amino acid sequence of SEQ ID NO: 368 or an amino acid sequence that is at least 95% identical to the amino acid sequence of SEQ ID NO: 368; the third polypeptide chain comprises the amino acid sequence of SEQ ID NO: 366 or an amino acid sequence that is at least 95% identical to the amino acid sequence of SEQ ID NO: 366; and the fourth polypeptide chain comprises the amino acid sequence of SEQ ID NO: 367 or an amino acid sequence that is at least 95% identical to the amino acid sequence of SEQ ID NO: 367;

(j) the first polypeptide chain comprises the amino acid sequence of SEQ ID NO: 377 or an amino acid sequence that is at least 95% identical to the amino acid sequence of SEQ ID NO: 377; the second polypeptide chain comprises the amino acid sequence of SEQ ID NO: 376 or an amino acid sequence that is at least 95% identical to the amino acid sequence of SEQ ID NO: 376; the third polypeptide chain comprises the amino acid sequence of SEQ ID NO: 374 or an amino acid sequence that is at least 95% identical to the amino acid sequence of SEQ ID NO: 374; and the fourth polypeptide chain comprises the amino acid sequence of SEQ ID NO: 375 or an amino acid sequence that is at least 95% identical to the amino acid sequence of SEQ ID NO: 375;

(k) the first polypeptide chain comprises the amino acid sequence of SEQ ID NO: 385 or an amino acid sequence that is at least 95% identical to the amino acid sequence of SEQ ID NO: 385; the second polypeptide chain comprises the amino acid sequence of SEQ ID NO: 384 or an amino acid sequence that is at least 95% identical to the amino acid sequence of SEQ ID NO: 384; the third polypeptide chain comprises the amino acid sequence of SEQ ID NO: 382 or an amino acid sequence that is at least 95% identical to the amino acid sequence of SEQ ID NO: 382; and the fourth polypeptide chain comprises the amino acid sequence of SEQ ID NO: 383 or an amino acid sequence that is at least 95% identical to the amino acid sequence of SEQ ID NO: 383;

(l) the first polypeptide chain comprises the amino acid sequence of SEQ ID NO: 393 or an amino acid sequence that is at least 95% identical to the amino acid sequence of SEQ ID NO: 393; the second polypeptide chain comprises the amino acid sequence of SEQ ID NO: 392 or an amino acid sequence that is at least 95% identical to the amino acid sequence of SEQ ID NO: 392; the third polypeptide chain comprises the amino acid sequence of SEQ ID NO: 390 or an amino acid sequence that is at least 95% identical to the amino acid sequence of SEQ ID NO: 390; and the fourth polypeptide chain comprises the amino acid sequence of SEQ ID NO: 391 or an amino acid sequence that is at least 95% identical to the amino acid sequence of SEQ ID NO: 391;

(m) the first polypeptide chain comprises the amino acid sequence of SEQ ID NO: 401 or an amino acid sequence that is at least 95% identical to the amino acid sequence of SEQ ID NO: 401; the second polypeptide chain comprises the amino acid sequence of SEQ ID NO: 400 or an amino acid sequence that is at least 95% identical to the amino acid sequence of SEQ ID NO: 400; the third polypeptide chain comprises the amino acid sequence of SEQ ID NO: 398 or an amino acid sequence that is at least 95% identical to the amino acid sequence of SEQ ID NO: 398; and the fourth polypeptide chain comprises the amino acid sequence of SEQ ID NO: 399 or an amino acid sequence that is at least 95% identical to the amino acid sequence of SEQ ID NO: 399;

(n) the first polypeptide chain comprises the amino acid sequence of SEQ ID NO: 409 or an amino acid sequence that is at least 95% identical to the amino acid sequence of SEQ ID NO: 409; the second polypeptide chain comprises the amino acid sequence of SEQ ID NO: 408 or an amino acid sequence that is at least 95% identical to the amino acid sequence of SEQ ID NO: 408; the third polypeptide chain comprises the amino acid sequence of SEQ ID NO: 406 or an amino acid sequence that is at least 95% identical to the amino acid sequence of SEQ ID NO: 406; and the fourth polypeptide chain comprises the amino acid sequence of SEQ ID NO: 407 or an amino acid sequence that is at least 95% identical to the amino acid sequence of SEQ ID NO: 407;

(p) the first polypeptide chain comprises the amino acid sequence of SEQ ID NO: 417 or an amino acid sequence that is at least 95% identical to the amino acid sequence of SEQ ID NO: 417; the second polypeptide chain comprises the amino acid sequence of SEQ ID NO: 416 or an amino acid sequence that is at least 95% identical to the amino acid sequence of SEQ ID NO: 416; the third polypeptide chain comprises the amino acid sequence of SEQ ID NO: 414 or an amino acid sequence that is at least 95% identical to the amino acid sequence of SEQ ID NO: 414; and the fourth polypeptide chain comprises the amino acid sequence of SEQ ID NO: 415 or an amino acid sequence that is at least 95% identical to the amino acid sequence of SEQ ID NO: 415;

(q) the first polypeptide chain comprises the amino acid sequence of SEQ ID NO: 425 or an amino acid sequence that is at least 95% identical to the amino acid sequence of SEQ ID NO: 425; the second polypeptide chain comprises the amino acid sequence of SEQ ID NO: 424 or an amino acid sequence that is at least 95% identical to the amino acid sequence of SEQ ID NO: 424; the third polypeptide chain comprises the amino acid sequence of SEQ ID NO: 422 or an amino acid sequence that is at least 95% identical to the amino acid sequence of SEQ ID NO: 422; and the fourth polypeptide chain comprises the amino acid sequence of SEQ ID NO: 423 or an amino acid sequence that is at least 95% identical to the amino acid sequence of SEQ ID NO: 423;

(r) the first polypeptide chain comprises the amino acid sequence of SEQ ID NO: 433 or an amino acid sequence that is at least 95% identical to the amino acid sequence of SEQ ID NO:433; the second polypeptide chain comprises the amino acid sequence of SEQ ID NO: 432 or an amino acid sequence that is at least 95% identical to the amino acid sequence of SEQ ID NO: 432; the third polypeptide chain comprises the amino acid sequence of SEQ ID NO: 430 or an amino acid sequence that is at least 95% identical to the amino acid sequence of SEQ ID NO: 430; and the fourth polypeptide chain comprises the amino acid sequence of SEQ ID NO: 431 or an amino acid sequence that is at least 95% identical to the amino acid sequence of SEQ ID NO: 431;

(s) the first polypeptide chain comprises the amino acid sequence of SEQ ID NO: 441 or an amino acid sequence that is at least 95% identical to the amino acid sequence of SEQ ID NO: 441; the second polypeptide chain comprises the amino acid sequence of SEQ ID NO: 440 or an amino acid sequence that is at least 95% identical to the amino acid sequence of SEQ ID NO: 440; the third polypeptide chain comprises the amino acid sequence of SEQ ID NO: 438 or an amino acid sequence that is at least 95% identical to the amino acid sequence of SEQ ID NO: 438; and the fourth polypeptide chain comprises the amino acid sequence of SEQ ID NO: 439 or an amino acid sequence that is at least 95% identical to the amino acid sequence of SEQ ID NO: 439;

(t) the first polypeptide chain comprises the amino acid sequence of SEQ ID NO: 449 or an amino acid sequence that is at least 95% identical to the amino acid sequence of SEQ ID NO: 449; the second polypeptide chain comprises the amino acid sequence of SEQ ID NO: 448 or an amino acid sequence that is at least 95% identical to the amino acid sequence of SEQ ID NO: 448; the third polypeptide chain comprises the amino acid sequence of SEQ ID NO: 446 or an amino acid sequence that is at least 95% identical to the amino acid sequence of SEQ ID NO: 446; and the fourth polypeptide chain comprises the amino acid sequence of SEQ ID NO: 447 or an amino acid sequence that is at least 95% identical to the amino acid sequence of SEQ ID NO: 447;

(u) the first polypeptide chain comprises the amino acid sequence of SEQ ID NO: 457 or an amino acid sequence that is at least 95% identical to the amino acid sequence of SEQ ID NO: 457; the second polypeptide chain comprises the amino acid sequence of SEQ ID NO: 456 or an amino acid sequence that is at least 95% identical to the amino acid sequence of SEQ ID NO: 456; the third polypeptide chain comprises the amino acid sequence of SEQ ID NO: 454 or an amino acid sequence that is at least 95% identical to the amino acid sequence of SEQ ID NO: 454; and the fourth polypeptide chain comprises the amino acid sequence of SEQ ID NO: 455 or an amino acid sequence that is at least 95% identical to the amino acid sequence of SEQ ID NO: 455;

(v) the first polypeptide chain comprises the amino acid sequence of SEQ ID NO: 465 or an amino acid sequence that is at least 95% identical to the amino acid sequence of SEQ ID NO: 465; the second polypeptide chain comprises the amino acid sequence of SEQ ID NO: 464 or an amino acid sequence that is at least 95% identical to the amino acid sequence of SEQ ID NO: 464; the third polypeptide chain comprises the amino acid sequence of SEQ ID NO: 462 or an amino acid sequence that is at least 95% identical to the amino acid sequence of SEQ ID NO: 462; and the fourth polypeptide chain comprises the amino acid sequence of SEQ ID NO: 463 or an amino acid sequence that is at least 95% identical to the amino acid sequence of SEQ ID NO: 463; or (w) the first polypeptide chain comprises the amino acid sequence of SEQ ID NO: 473 or an amino acid sequence that is at least 95% identical to the amino acid sequence of SEQ ID NO: 473; the second polypeptide chain comprises the amino acid sequence of SEQ ID NO: 472 or an amino acid sequence that is at least 95% identical to the amino acid sequence of SEQ ID NO: 472; the third polypeptide chain comprises the amino acid sequence of SEQ ID NO: 470 or an amino acid sequence that is at least 95% identical to the amino acid sequence of SEQ ID NO: 470; and the fourth polypeptide chain comprises the amino acid sequence of SEQ ID NO: 471 or an amino acid sequence that is at least 95% identical to the amino acid sequence of SEQ ID NO: 471.

In one embodiment, the disclosure provides an isolated nucleic acid molecule comprising a nucleotide sequence encoding the binding protein according to any of the above embodiments. In one embodiment, the disclosure provides an expression vector comprising the nucleic acid molecule according to any of the above embodiments. In one embodiment, the disclosure provides an isolated host cell comprising the nucleic acid molecule according to any of the above embodiments. In one embodiment, the disclosure provides an isolated host cell comprising the expression vector according to any of the above embodiments. In some embodiments, the isolated host cell is a mammalian cell or an insect cell. In one embodiment, the disclosure provides a vector system comprising one or more vectors encoding a first, second, third, and fourth polypeptide chain of a binding protein according to any of the above embodiments. In some embodiments, the vector system comprises a first vector encoding the first polypeptide chain of the binding protein, a second vector encoding the second polypeptide chain of the binding protein, a third vector encoding the third polypeptide chain of the binding protein, and a fourth vector encoding the fourth polypeptide chain of the binding protein. In some embodiments, the vector system comprises a first vector encoding the first and second polypeptide chains of the binding protein, and a second vector encoding the third and fourth polypeptide chains of the binding protein. In some embodiments, the one or more vectors are expression vectors. In one embodiment, the disclosure provides an isolated host cell comprising the vector system according to any of the above embodiments. In some embodiments, the isolated host cell is a mammalian cell or an insect cell. In one embodiment, the disclosure provides a method of producing a binding protein, the method comprising: a) culturing a host cell according to any of the above embodiments under conditions such that the host cell expresses the binding protein; and b) isolating the binding protein from the host cell.

In one embodiment, the disclosure provides a method of preventing and/or treating HIV infection in a patient comprising administering to the patient a therapeutically effective amount of at least one binding protein according to any of the above embodiments. In some embodiments, the binding protein is co-administered with standard anti-retroviral therapy. In some embodiments, administration of the at least one binding protein results in the neutralization of one or more HIV virions. In some embodiments, administration of the at least one binding protein results in the elimination of one or more latently and/or chronically HIV-infected cells in the patient. In some embodiments, the patient is a human.

In one embodiment, the disclosure provides a binding protein according to any of the above embodiments for the prevention or treatment of an HIV infection in a patient. In some embodiments, the binding protein is co-administered with standard anti-retroviral therapy. In some embodiments, the binding protein causes the neutralization of one or more HIV virions in the patient. In some embodiments, the binding protein causes the elimination of one or more latently and/or chronically HIV-infected cells in the patient. In some embodiments, the patient is a human.

Specific embodiments of the invention will become evident from the following more detailed description of certain embodiments and the claims.

It is to be understood that one, some, or all of the properties of the various embodiments described herein may be combined to form other embodiments of the present invention. These and other aspects of the invention will become apparent to one of skill in the art.

BRIEF DESCRIPTION OF THE DRAWINGS

FIG. 1A shows a trispecific binding protein comprising a "knobs-into-holes" modification, wherein the knob is on the first pair of polypeptides. FIG. 1B shows a trispecific binding protein comprising a "knobs-into-holes" modification, wherein the knob is on the second pair of polypeptides. FIG. 1C shows the orientation of variable domains on the polypeptide chains, and the knob/hole orientation for binding proteins 1-31 shown in Tables 1 and 2. "Heavy chain A" (e.g., a third polypeptide chain of the present disclosure) indicates the variable domain of heavy chain A. "Light chain A" (e.g., a fourth polypeptide chain of the present disclosure) indicates the variable domain of light chain A. "Heavy chain B" (e.g., a second polypeptide chain of the present disclosure) indicates variable domain 1 and variable domain 2 of heavy chain B. "Light chain B" (e.g., a first polypeptide chain of the present disclosure) indicates variable domain 1 and variable domain 2 of light chain B. FIG. 1D shows the orientation of variable domains on the polypeptide chains, and the knob/hole orientation for binding proteins 32-53 shown in Tables 1 and 2. "Heavy chain A" (e.g., a third polypeptide chain of the present disclosure) indicates the variable domain of heavy chain A. "Light chain A" (e.g., a fourth polypeptide chain of the present disclosure) indicates the variable domain of light chain A. "Heavy chain B" (e.g., a second polypeptide chain of the present disclosure) indicates variable domain 1 and variable domain 2 of heavy chain B. "Light chain B" (e.g., a first polypeptide chain of the present disclosure) indicates variable domain 1 and variable domain 2 of light chain B.

FIG. 2A shows the elution profile of the trispecific binding proteins during purification using protein A affinity chromatography. FIG. 2B shows purification of monomeric proteins by Superdex200 size exclusion chromatography.

FIG. 3A shows the elution profile of the parental antibodies during purification using protein A affinity chromatography. FIG. 3B shows purification of monomeric proteins by Superdex200 size exclusion chromatography.

FIG. 4A shows the size exclusion chromatography profiles of the bispecific binding proteins. FIG. 4B shows the size exclusion chromatography profiles of the trispecific binding proteins.

FIG. 13A shows the results for trispecific binding proteins incubated with CEM-BaL cells. FIG. 13B shows the results for trispecific binding proteins incubated with ACH2 cells. FIG. 13C shows the results for trispecific binding proteins incubated with J1.1 cells.

DETAILED DESCRIPTION

Figure 1A:
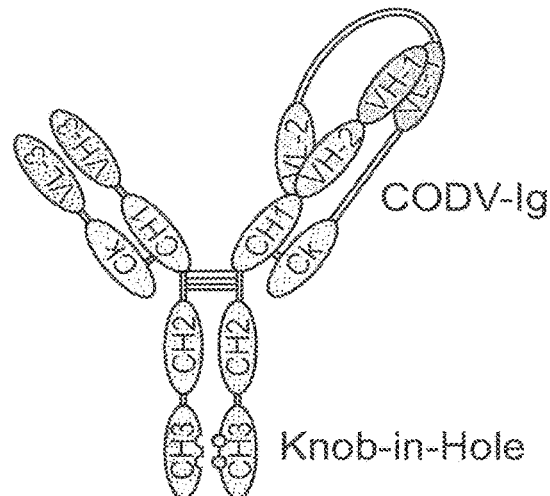
FIGS. 1A-D show schematic representations of trispecific binding proteins comprising four polypeptide chains that form three antigen binding sites that specifically bind three different epitopes on one or more antigens, wherein a first pair of polypeptides possess dual variable domains having a cross-over orientation forming two antigen binding sites (comprising $V_{H1}$-$V_{L1}$ and $V_{H2}$-$V_{L2}$) and wherein a second pair of polypeptides possess a single antigen binding site (comprising $V_{H3}$-$V_{L3}$), in accordance with some embodiments.
Figure 1B:
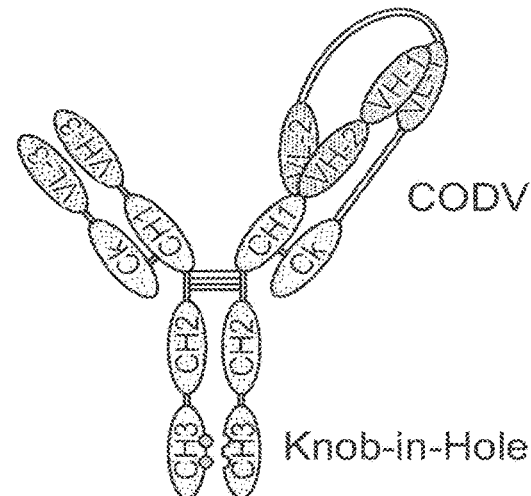
Figure 1C:
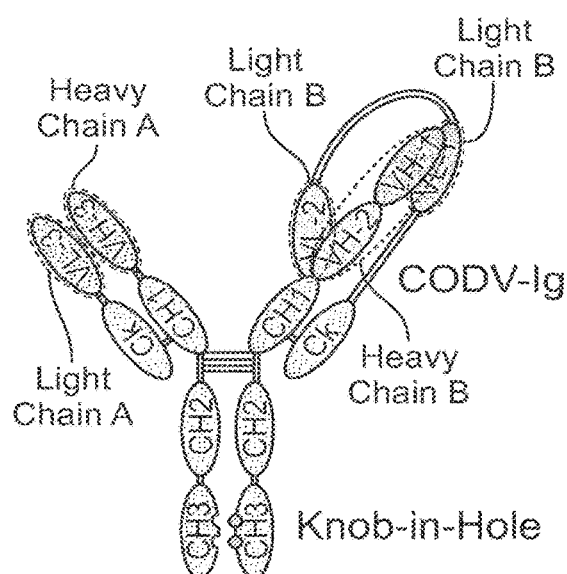
Figure 1D:
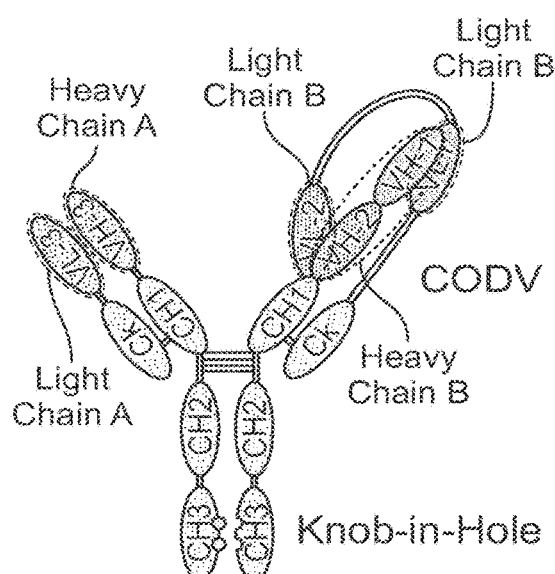
Figure 2A:
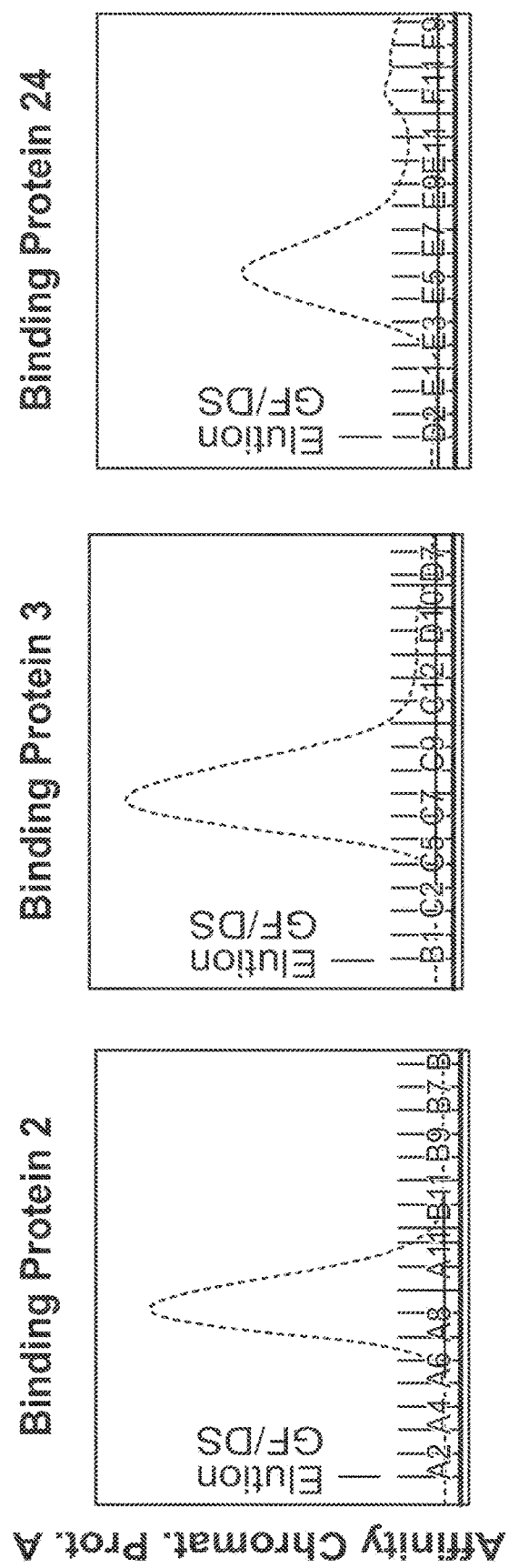
FIGS. 2A-B show purification of three trispecific binding proteins first using affinity chromatography, and then using preparative size exclusion chromatography.
Figure 2B:
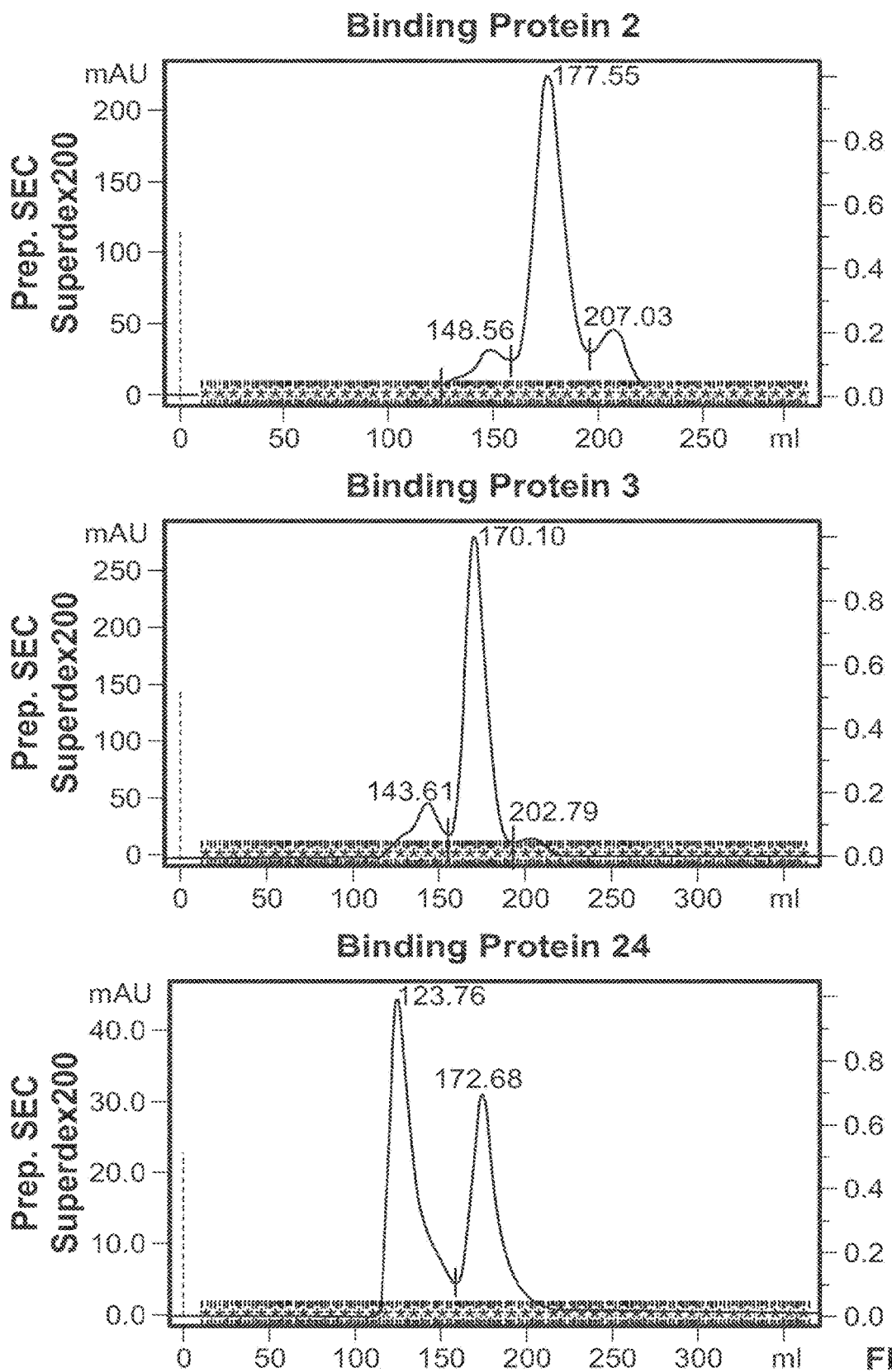
Figure 3A:
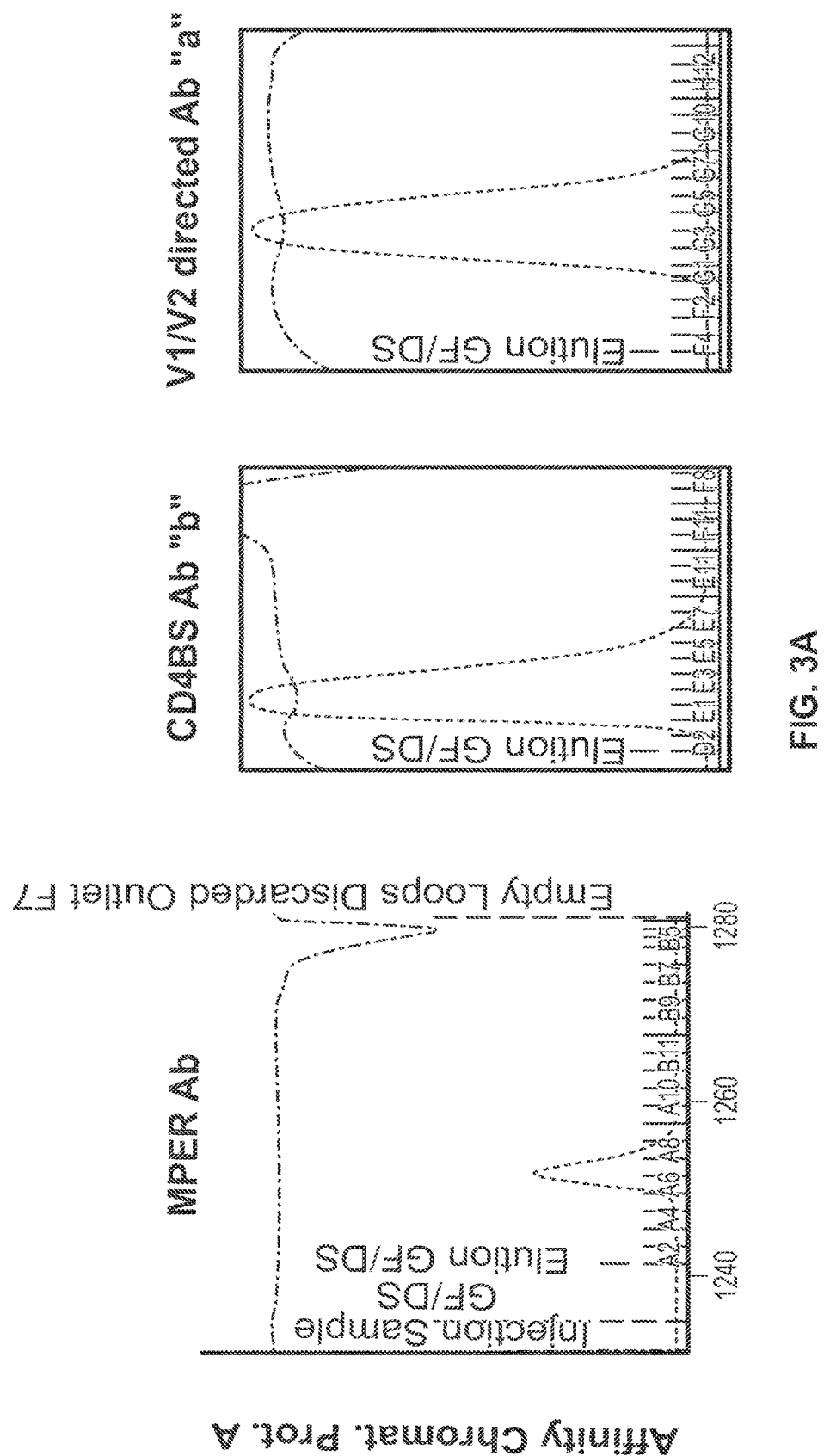
FIGS. 3A-B show purification of the MPER Ab, CD4BS Ab "b", and V1/V2 directed Ab "a" parental antibodies first using affinity chromatography, and then using preparative size exclusion chromatography.
Figure 3B:
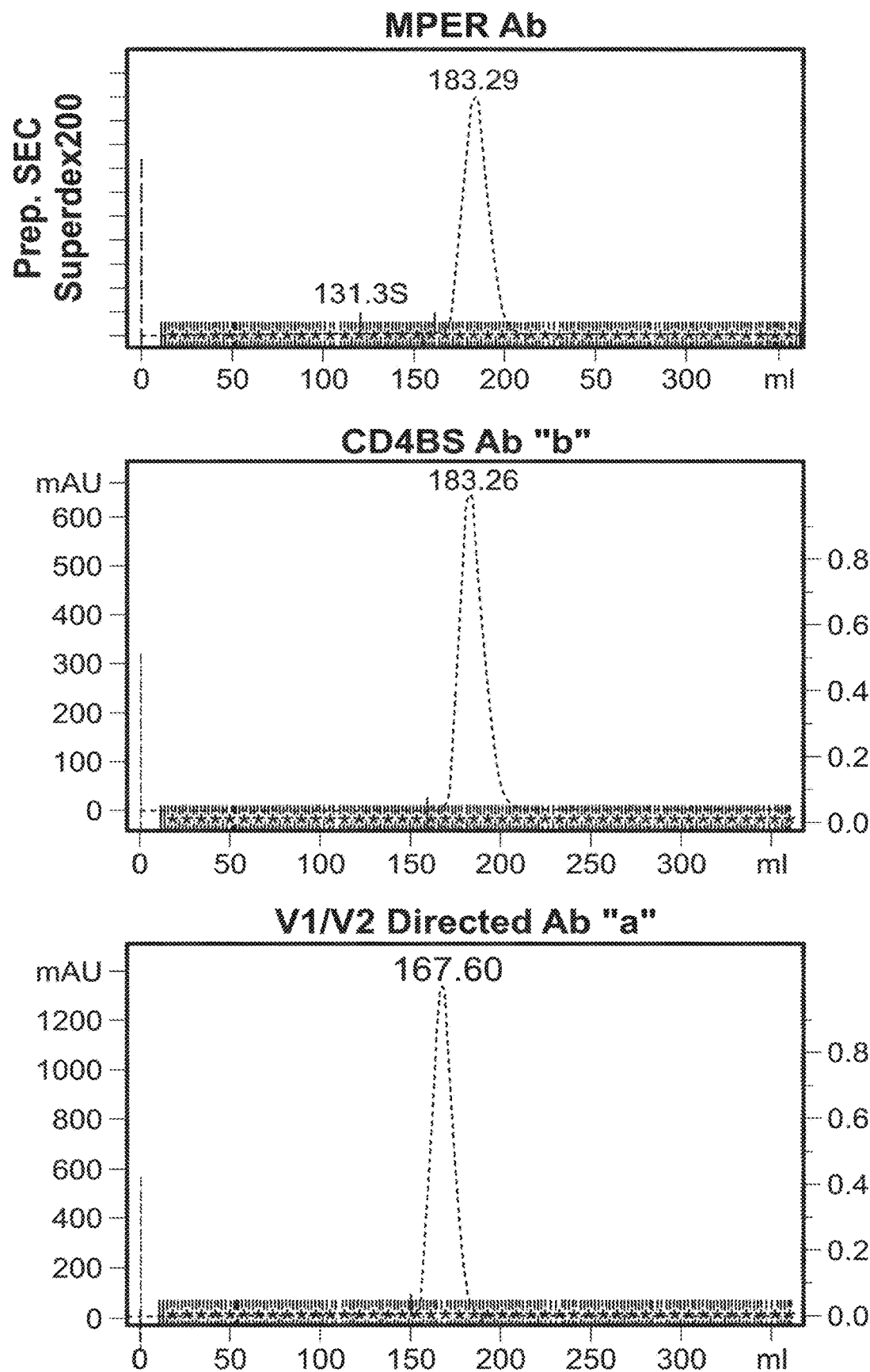
Figure 4A:
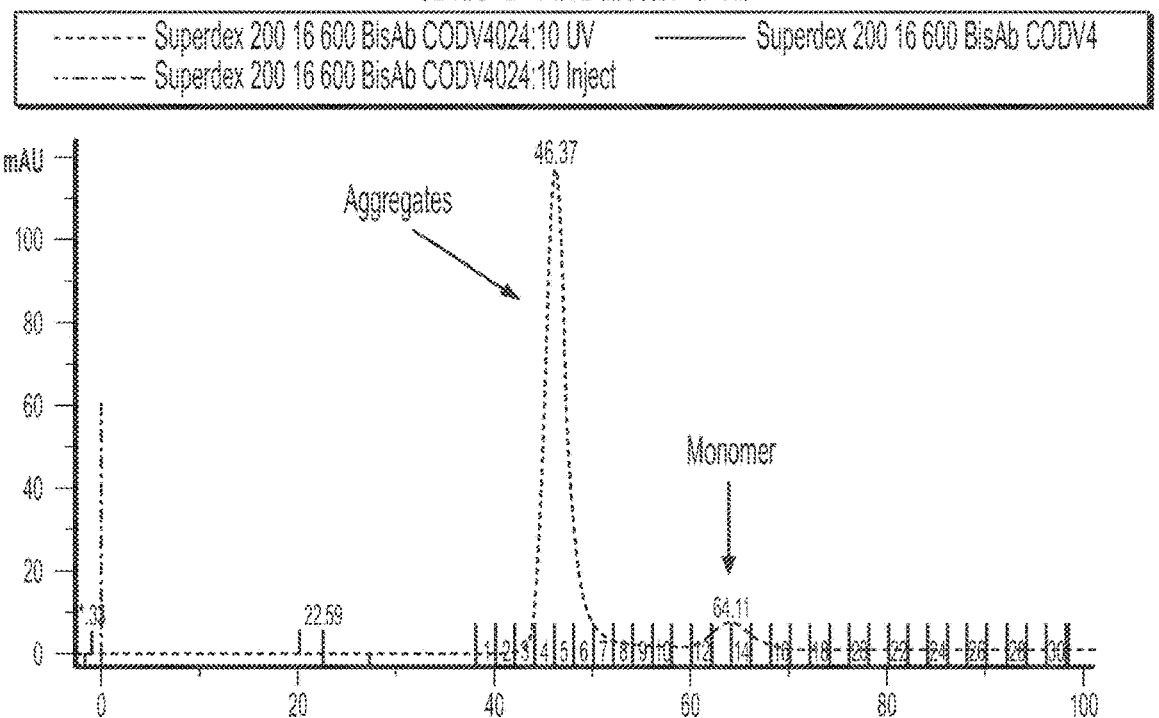
FIGS. 4A-B show the size exclusion chromatography profiles of bispecific and trispecific binding proteins.
Figure 4A:
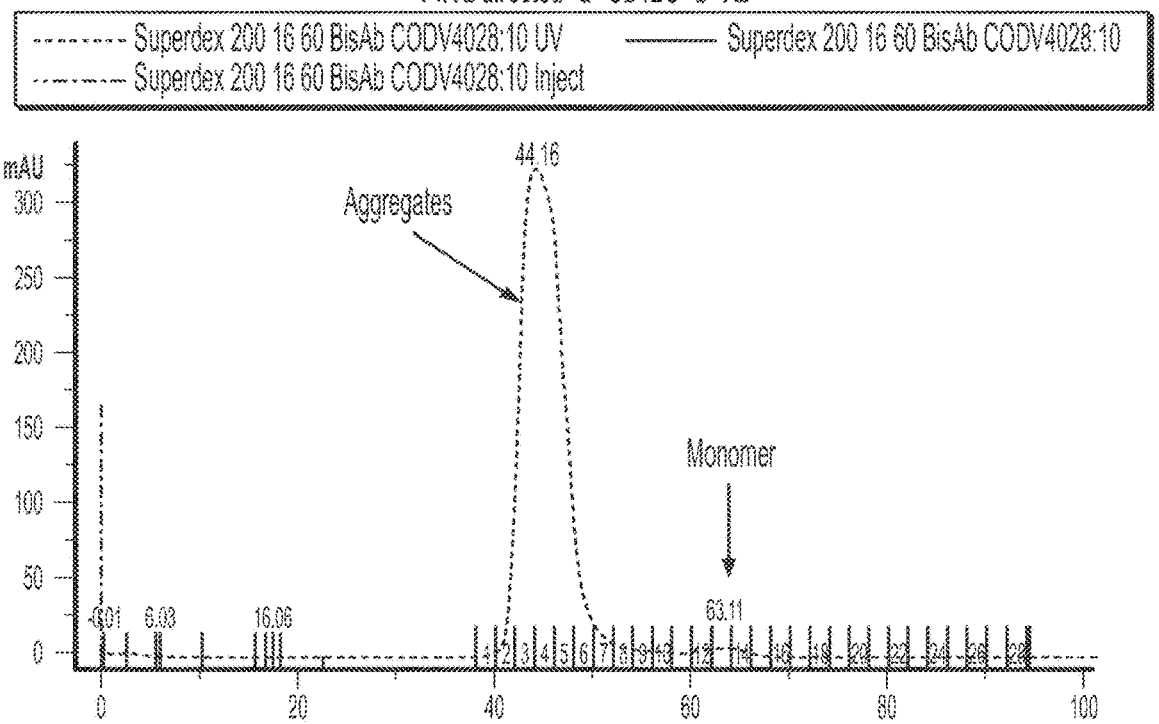
Figure 4B:
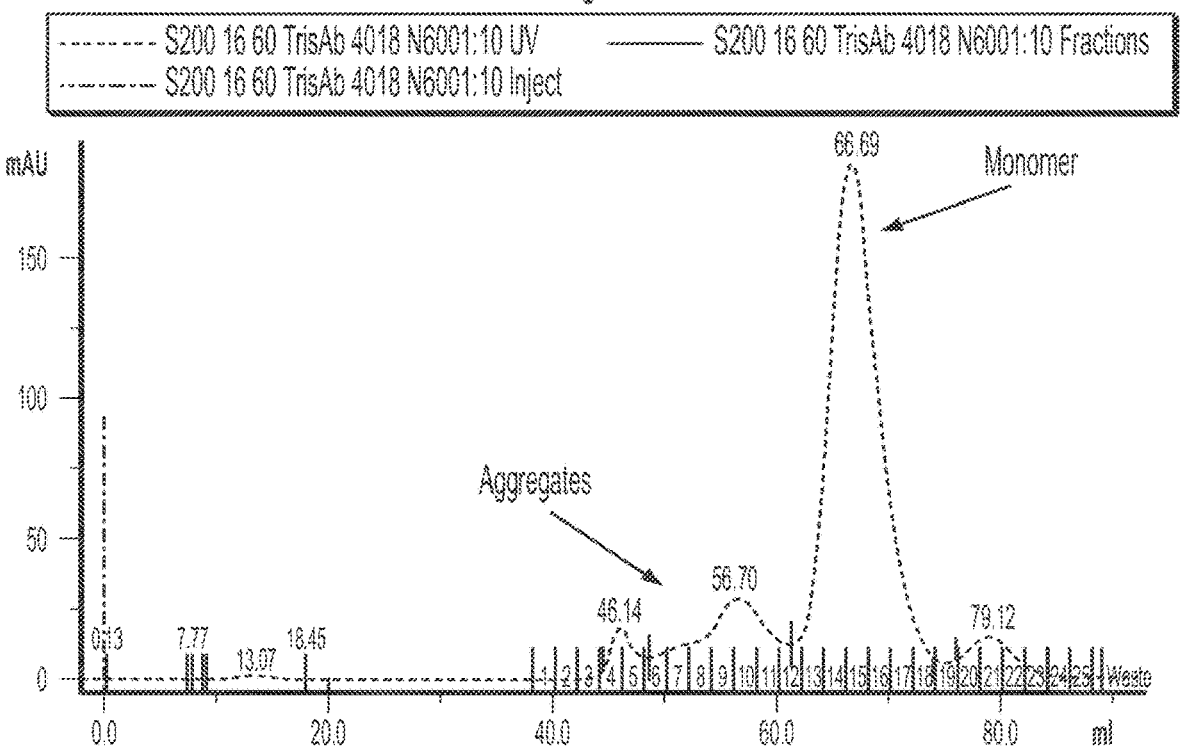
Figure 4B:
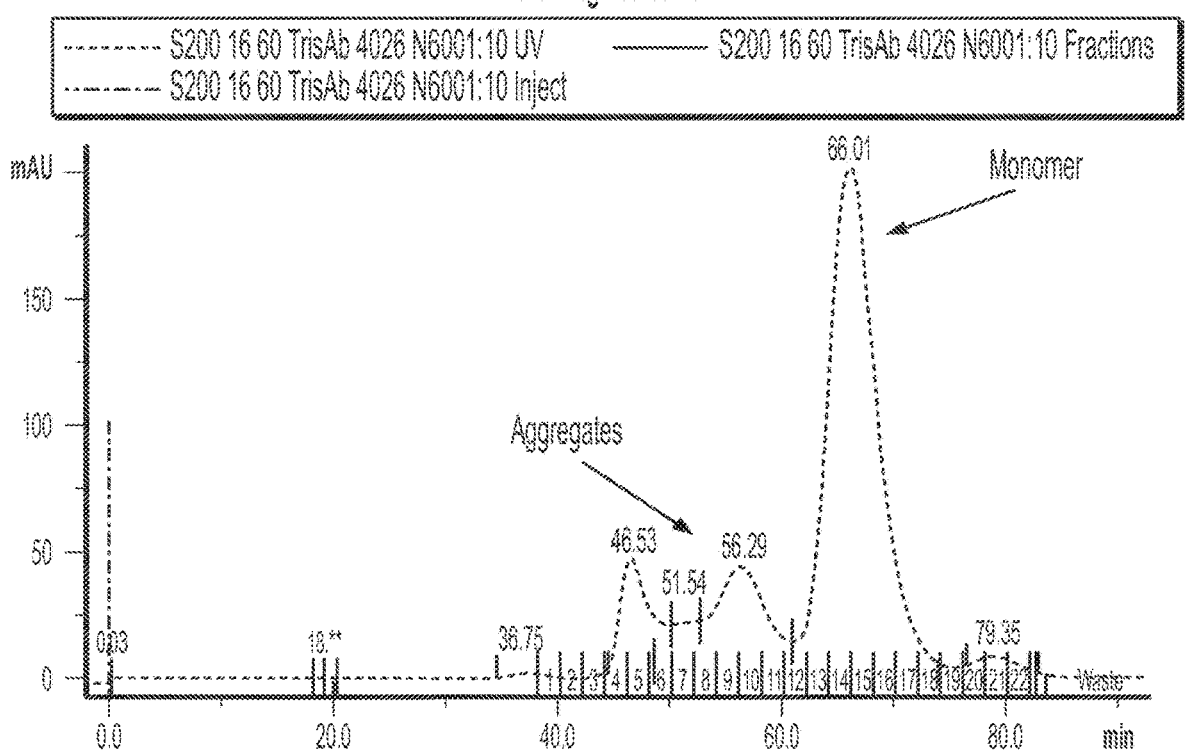
Figure 4B:
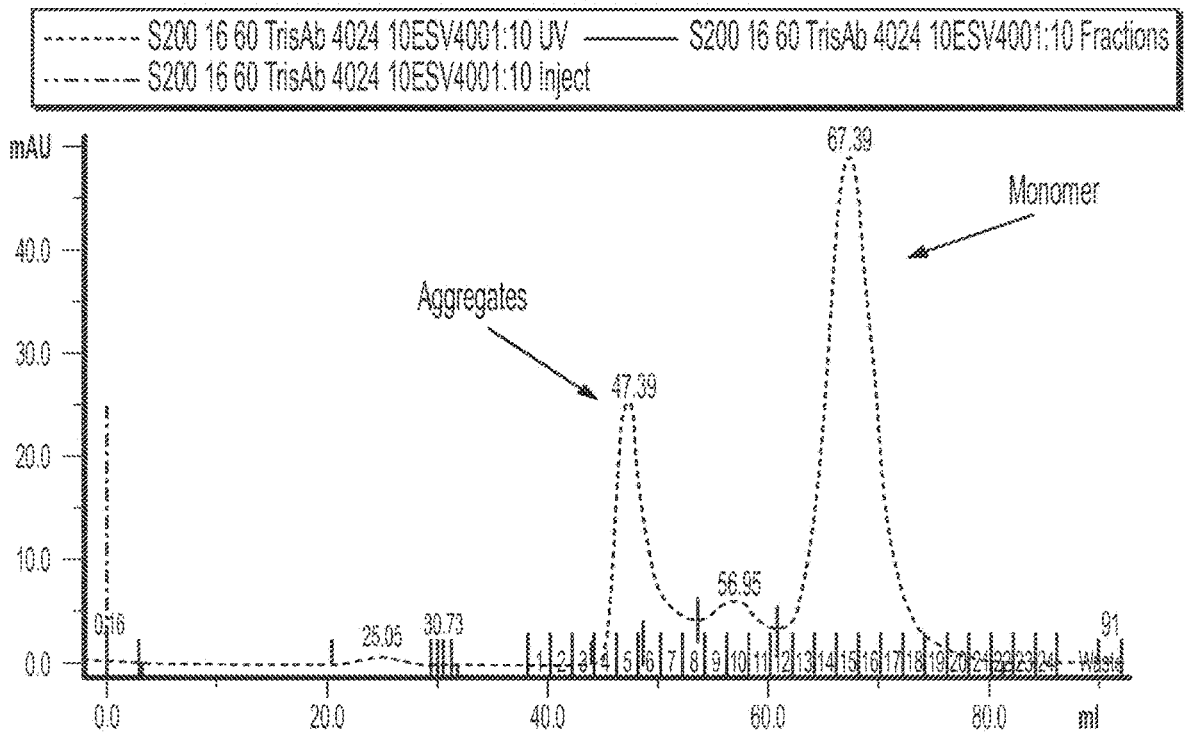
Figure 4B:
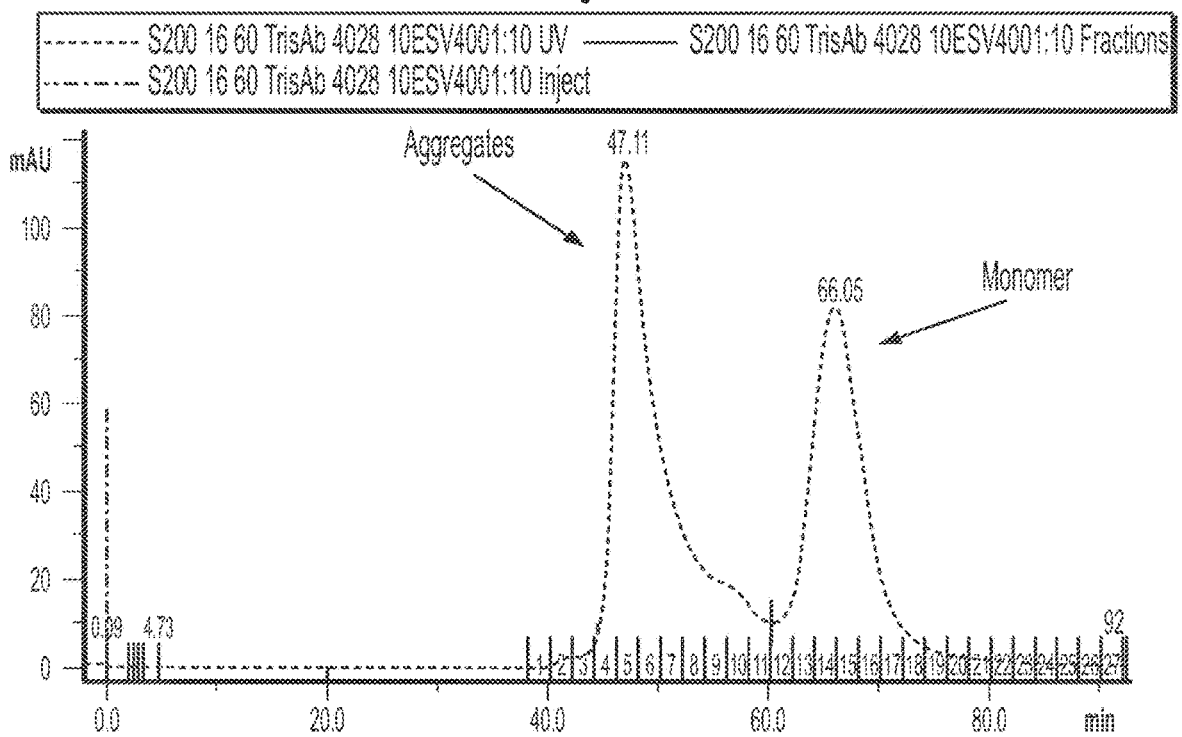
Figure 5:
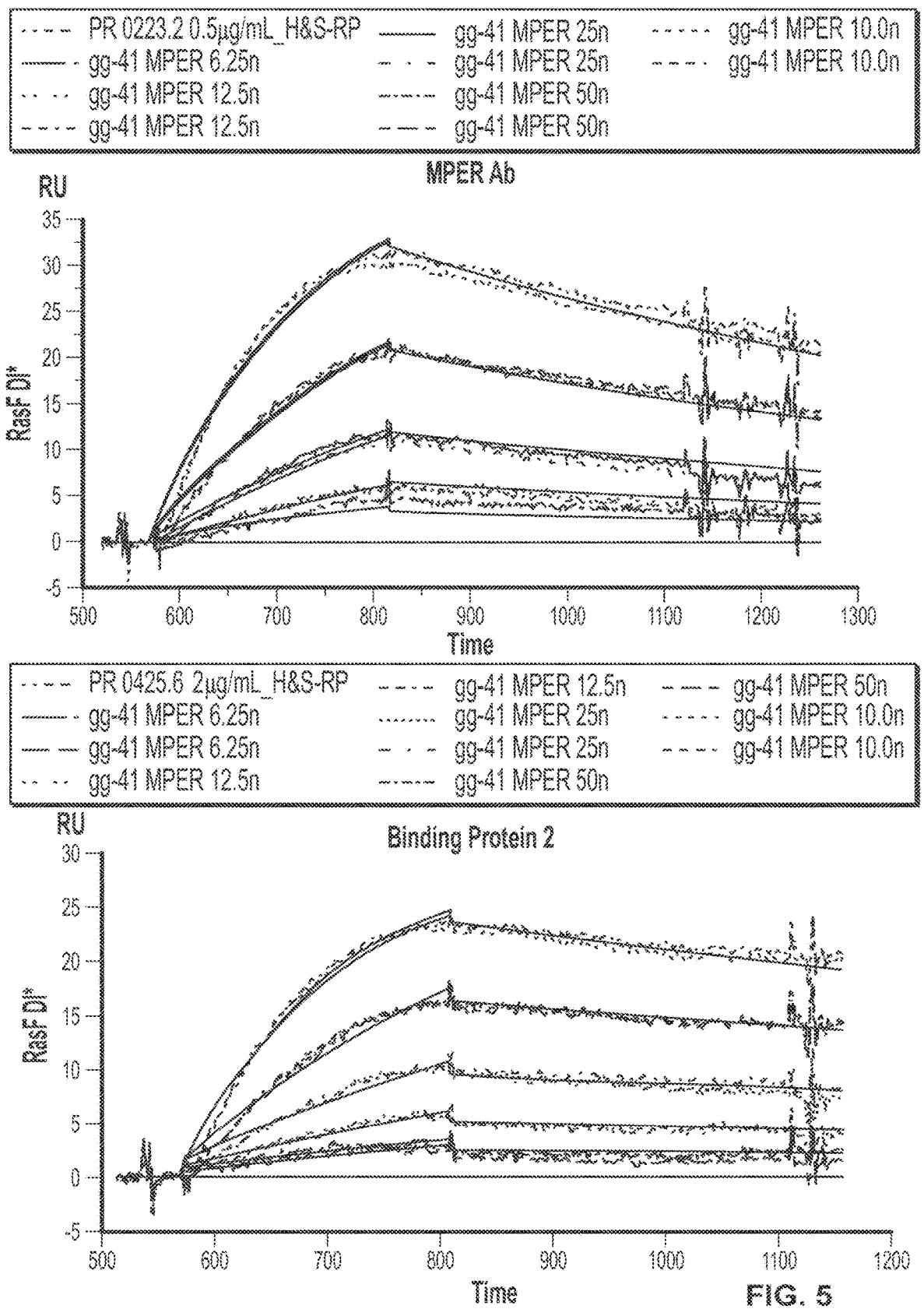
FIG. 5 shows the Biacore sensograms of the binding kinetics of three trispecific binding proteins and the parental MPER Ab antibody for an HIV gp41-derived peptide (the MPER binding site), as assessed by the standard Biacore-based kinetic assay.
Figure 5:
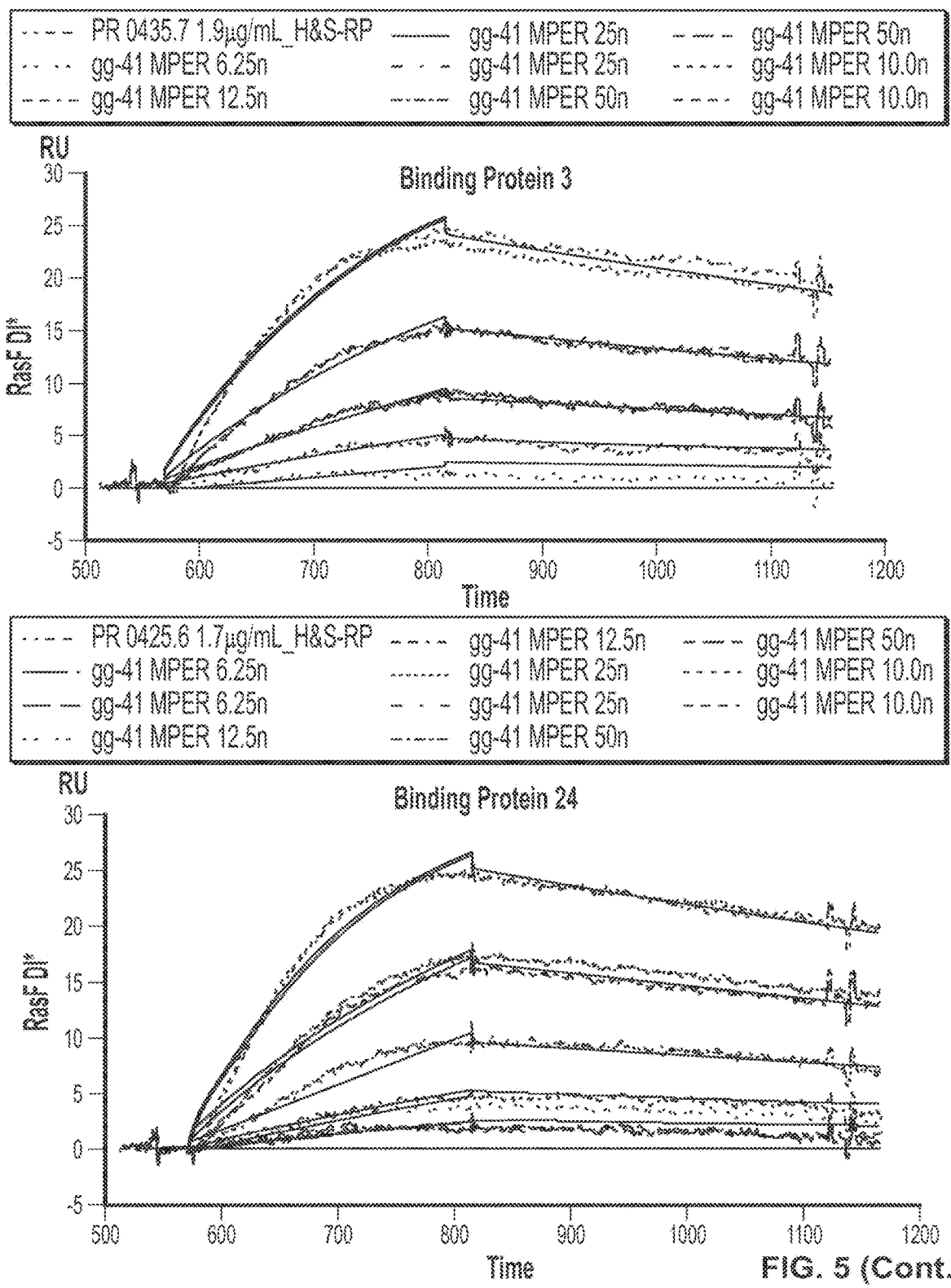

The present disclosure provides trispecific and/or trivalent binding proteins comprising four polypeptide chains that form three antigen binding sites that specifically bind to one or more human immunodeficiency virus (HIV) target proteins and/or one or more T-cell receptor target proteins, wherein a first pair of polypeptides forming the binding protein possess dual variable domains having a cross-over orientation and wherein a second pair of polypeptides forming the binding protein possess a single variable domain.

The following description sets forth exemplary methods, parameters, and the like. It should be recognized, however, that such description is not intended as a limitation on the scope of the present disclosure but is instead provided as a description of exemplary embodiments.

Definitions

As utilized in accordance with the present disclosure, the following terms, unless otherwise indicated, shall be understood to have the following meanings. Unless otherwise required by context, singular terms shall include pluralities and plural terms shall include the singular.

The term "polynucleotide" as used herein refers to single-stranded or double-stranded nucleic acid polymers of at least 10 nucleotides in length. In certain embodiments, the nucleotides comprising the polynucleotide can be ribonucleotides or deoxyribonucleotides or a modified form of either type of nucleotide. Such modifications include base modifications such as bromuridine, ribose modifications such as arabinoside and 2',3'-dideoxyribose, and internucleotide linkage modifications such as phosphorothioate, phosphorodithioate, phosphoroselenoate, phosphorodiselenoate, phosphoroanilothioate, phosphoraniladate and phosphoroamidate. The term "polynucleotide" specifically includes single-stranded and double-stranded forms of DNA.

An "isolated polynucleotide" is a polynucleotide of genomic, cDNA, or synthetic origin or some combination thereof, which: (1) is not associated with all or a portion of a polynucleotide in which the isolated polynucleotide is found in nature, (2) is linked to a polynucleotide to which it is not linked in nature, or (3) does not occur in nature as part of a larger sequence.

An "isolated polypeptide" is one that: (1) is free of at least some other polypeptides with which it would normally be found, (2) is essentially free of other polypeptides from the same source, e.g., from the same species, (3) is expressed by a cell from a different species, (4) has been separated from at least about 50 percent of polynucleotides, lipids, carbohydrates, or other materials with which it is associated in nature, (5) is not associated (by covalent or noncovalent interaction) with portions of a polypeptide with which the "isolated polypeptide" is associated in nature, (6) is operably associated (by covalent or noncovalent interaction) with a polypeptide with which it is not associated in nature, or (7) does not occur in nature. Such an isolated polypeptide can be encoded by genomic DNA, cDNA, mRNA or other RNA, of synthetic origin, or any combination thereof. Preferably, the isolated polypeptide is substantially free from polypeptides or other contaminants that are found in its natural environment that would interfere with its use (therapeutic, diagnostic, prophylactic, research or otherwise).

Naturally occurring antibodies typically comprise a tetramer. Each such tetramer is typically composed of two identical pairs of polypeptide chains, each pair having one full-length "light" chain (typically having a molecular weight of about 25 kDa) and one full-length "heavy" chain (typically having a molecular weight of about 50-70 kDa). The terms "heavy chain" and "light chain" as used herein refer to any immunoglobulin polypeptide having sufficient variable domain sequence to confer specificity for a target antigen. The amino-terminal portion of each light and heavy chain typically includes a variable domain of about 100 to 110 or more amino acids that typically is responsible for antigen recognition. The carboxy-terminal portion of each chain typically defines a constant domain responsible for effector function. Thus, in a naturally occurring antibody, a full-length heavy chain immunoglobulin polypeptide includes a variable domain ($V_H$) and three constant domains ($C_{H1}$, $C_{H2}$, and $C_{H3}$), wherein the $V_H$ domain is at the amino-terminus of the polypeptide and the $C_{H3}$ domain is at the carboxyl-terminus, and a full-length light chain immunoglobulin polypeptide includes a variable domain ($V_L$) and a constant domain ($C_L$), wherein the $V_L$ domain is at the amino-terminus of the polypeptide and the $C_L$ domain is at the carboxyl-terminus.

Human light chains are typically classified as kappa and lambda light chains, and human heavy chains are typically classified as mu, delta, gamma, alpha, or epsilon, and define the antibody's isotype as IgM, IgD, IgG, IgA, and IgE, respectively. IgG has several subclasses, including, but not limited to, IgG1, IgG2, IgG3, and IgG4. IgM has subclasses including, but not limited to, IgM1 and IgM2. IgA is similarly subdivided into subclasses including, but not limited to, IgA1 and IgA2. Within full-length light and heavy chains, the variable and constant domains typically are joined by a "J" region of about 12 or more amino acids, with the heavy chain also including a "D" region of about 10 more amino acids. See, e.g., FUNDAMENTAL IMMUNOLOGY (Paul, W., ed., Raven Press, 2nd ed., 1989), which is incorporated by reference in its entirety for all purposes. The variable regions of each light/heavy chain pair typically form an antigen binding site. The variable domains of naturally occurring antibodies typically exhibit the same general structure of relatively conserved framework regions (FR) joined by three hypervariable regions, also called complementarity determining regions or CDRs. The CDRs from the two chains of each pair typically are aligned by the framework regions, which may enable binding to a specific epitope. From the amino-terminus to the carboxyl-terminus, both light and heavy chain variable domains typically comprise the domains FR1, CDR1, FR2, CDR2, FR3, CDR3, and FR4.

The term "CDR set" refers to a group of three CDRs that occur in a single variable region capable of binding the antigen. The exact boundaries of these CDRs have been defined differently according to different systems. The system described by Kabat (Kabat et al., SEQUENCES OF PROTEINS OF IMMUNOLOGICAL INTEREST (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia and Lesk, 1987, *J. Mol. Biol.* 196: 901-17; Chothia et al., 1989, *Nature* 342: 877-83) found that certain subportions within Kabat CDRs adopt nearly identical peptide backbone conformations, despite having great diversity at the level of amino acid sequence. These sub-portions were designated as L1, L2, and L3 or H1, H2, and H3 where the "L" and the "H" designates the light chain and the heavy chain regions, respectively. These regions may be referred to as Chothia CDRs, which have boundaries that overlap with Kabat CDRs. Other boundaries defining CDRs overlapping with the Kabat CDRs have been described by Padlan, 1995, *FASEB J.* 9: 133-39; MacCallum, 1996, *J. Mol. Biol.* 262(5): 732-45; and Lefranc, 2003, *Dev. Comp. Immunol.* 27: 55-77. Still other CDR boundary definitions may not strictly follow one of the herein systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems, although certain embodiments use Kabat or Chothia defined CDRs. Identification of predicted CDRs using the amino acid sequence is well known in the field, such as in Martin, A. C. "Protein sequence and structure analysis of antibody variable domains," *In Antibody Engineering*, Vol. 2. Kontermann R., Dübel S., eds. Springer-Verlag, Berlin, p. 33-51 (2010). The amino acid sequence of the heavy and/or light chain variable domain may be also inspected to identify the sequences of the CDRs by other conventional methods, e.g., by comparison to known amino acid sequences of other heavy and light chain variable regions to determine the regions of sequence hypervariability. The numbered sequences may be aligned by eye, or by employing an alignment program such as one of the CLUSTAL suite of programs, as described in Thompson, 1994, *Nucleic Acids Res.* 22: 4673-80. Molecular models are conventionally used to correctly delineate framework and CDR regions and thus correct the sequence-based assignments.

The term "Fc" as used herein refers to a molecule comprising the sequence of a non-antigen-binding fragment resulting from digestion of an antibody or produced by other means, whether in monomeric or multimeric form, and can contain the hinge region. The original immunoglobulin source of the native Fc is preferably of human origin and can be any of the immunoglobulins, although IgG1 and IgG2 are preferred. Fc molecules are made up of monomeric polypeptides that can be linked into dimeric or multimeric forms by covalent (i.e., disulfide bonds) and non-covalent association. The number of intermolecular disulfide bonds between monomeric subunits of native Fc molecules ranges from 1 to 4 depending on class (e.g., IgG, IgA, and IgE) or subclass (e.g., IgG1, IgG2, IgG3, IgA1, and IgA2). One example of a Fc is a disulfide-bonded dimer resulting from papain digestion of an IgG. The term "Fc" as used herein is generic to the monomeric, dimeric, and multimeric forms.

A F(ab) fragment typically includes one light chain and the $V_H$ and $C_{H1}$ domains of one heavy chain, wherein the $V_H$-$C_{H1}$ heavy chain portion of the F(ab) fragment cannot form a disulfide bond with another heavy chain polypeptide. As used herein, a F(ab) fragment can also include one light chain containing two variable domains separated by an amino acid linker and one heavy chain containing two variable domains separated by an amino acid linker and a $C_{H1}$ domain.

A F(ab') fragment typically includes one light chain and a portion of one heavy chain that contains more of the constant region (between the $C_{H1}$ and $C_{H2}$ domains), such that an interchain disulfide bond can be formed between two heavy chains to form a F(ab')$_2$ molecule.

The term "binding protein" as used herein refers to a non-naturally occurring (or recombinant or engineered) molecule that specifically binds to at least one target antigen, and which comprises four polypeptide chains that form at least three antigen binding sites, wherein a first polypeptide chain has a structure represented by the formula:

$$V_{L2}\text{-}L_1\text{-}V_{L1}\text{-}L_2\text{-}C_L \qquad [I]$$

and a second polypeptide chain has a structure represented by the formula:

$$V_{H1}\text{-}L_3\text{-}V_{H2}\text{-}L_4\text{-}C_{H1} \qquad [II]$$

and a third polypeptide chain has a structure represented by the formula:

$$V_{H3}\text{-}C_{H1} \qquad [III]$$

and a fourth polypeptide chain has a structure represented by the formula:

$$V_{L3}\text{-}C_L \qquad [IV]$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$, and $L_4$ are amino acid linkers;
and wherein the polypeptide of formula I and the polypeptide of formula II form a cross-over light chain-heavy chain pair.

A "recombinant" molecule is one that has been prepared, expressed, created, or isolated by recombinant means.

One embodiment of the disclosure provides binding proteins having biological and immunological specificity to between one and three target antigens. Another embodiment of the disclosure provides nucleic acid molecules comprising nucleotide sequences encoding polypeptide chains that form such binding proteins. Another embodiment of the disclosure provides expression vectors comprising nucleic acid molecules comprising nucleotide sequences encoding polypeptide chains that form such binding proteins. Yet another embodiment of the disclosure provides host cells that express such binding proteins (i.e., comprising nucleic acid molecules or vectors encoding polypeptide chains that form such binding proteins).

The term "swapability" as used herein refers to the interchangeability of variable domains within the binding protein format and with retention of folding and ultimate binding affinity. "Full swapability" refers to the ability to swap the order of both $V_{H1}$ and $V_{H2}$ domains, and therefore the order of $V_{L1}$ and $V_{L2}$ domains, in the polypeptide chain of formula I or the polypeptide chain of formula II (i.e., to reverse the order) while maintaining full functionality of the binding protein as evidenced by the retention of binding affinity. Furthermore, it should be noted that the designations $V_H$ and $V_L$ refer only to the domain's location on a particular protein chain in the final format. For example, $V_{H1}$ and $V_{H2}$ could be derived from $V_{L1}$ and $V_{L2}$ domains in parent antibodies and placed into the $V_{H1}$ and $V_{H2}$ positions in the binding protein. Likewise, $V_{L1}$ and $V_{L2}$ could be derived from $V_{H1}$ and $V_{H2}$ domains in parent antibodies and placed in the $V_{H1}$ and $V_{H2}$ positions in the binding protein. Thus, the $V_H$ and $V_L$ designations refer to the present location and not the original location in a parent antibody. $V_H$ and $V_L$ domains are therefore "swappable."

The term "antigen" or "target antigen" or "antigen target" as used herein refers to a molecule or a portion of a molecule that is capable of being bound by a binding protein, and additionally is capable of being used in an animal to produce antibodies capable of binding to an epitope of that antigen. A target antigen may have one or more epitopes. With respect to each target antigen recognized by a binding protein, the binding protein is capable of competing with an intact antibody that recognizes the target antigen.

The term "HIV" as used herein means Human Immunodeficiency Virus. As used herein, the term "HIV infection" generally encompasses infection of a host, particularly a human host, by the human immunodeficiency virus (HIV) family of retroviruses including, but not limited to, HIV I, HIV II, HIV III (also known as HTLV-II, LAV-1, LAV-2). HIV can be used herein to refer to any strains, forms, subtypes, clades and variations in the HIV family. Thus, treating HIV infection will encompass the treatment of a person who is a carrier of any of the HIV family of retroviruses or a person who is diagnosed with active AIDS, as well as the treatment or prophylaxis of the AIDS-related conditions in such persons.

The term "AIDS" as used herein means Acquired Immunodeficiency Syndrome. AIDS is caused by HIV.

The terms "CD4bs" or "CD4 binding site" refer to the binding site for CD4 (cluster of differentiation 4), which is a glycoprotein found on the surface of immune cells such as T helper cells, monocytes, macrophages, and dendritic cells.

The term "CD3" is cluster of differentiation factor 3 polypeptide and is a T-cell surface protein that is typically part of the T cell receptor (TCR) complex.

"CD28" is cluster of differentiation 28 polypeptide and is a T-cell surface protein that provides co-stimulatory signals for T-cell activation and survival.

The term "glycoprotein 160" or "gp160 protein" refers to the envelope glycoprotein complex of HIV and which is a homotrimer that is cleaved into gp120 and gp41 subunits.

The term "MPER" refers to the membrane-proximal external region of glycoprotein 41 (gp41), which is a subunit of the envelope protein complex of retroviruses, including HIV.

The term "glycan" refers to the carbohydrate portion of a glycoconjugate, such as a glycoprotein, glycolipid, or a proteoglycan. In the disclosed binding proteins, glycan refers to the HIV-1 envelope glycoprotein gp120.

The term "T-cell engager" refers to binding proteins directed to a host's immune system, more specifically the T cells' cytotoxic activity as well as directed to a HIV target protein.

The term "trimer apex" refers to apex of HIV-1 envelope glycoprotein gp120.

The term "monospecific binding protein" refers to a binding protein that specifically binds to one antigen target.

The term "monovalent binding protein" refers to a binding protein that has one antigen binding site.

The term "bispecific binding protein" refers to a binding protein that specifically binds to two different antigen targets.

The term "bivalent binding protein" refers to a binding protein that has two binding sites.

The term "trispecific binding protein" refers to a binding protein that specifically binds to three different antigen targets.

The term "trivalent binding protein" refers to a binding protein that has three binding sites. In particular embodiments the trivalent binding protein can bind to one antigen target. In other embodiments, the trivalent binding protein can bind to two antigen targets. In other embodiments, the trivalent binding protein can bind to three antigen targets.

An "isolated" binding protein is one that has been identified and separated and/or recovered from a component of its natural environment. Contaminant components of its natural environment are materials that would interfere with diagnostic or therapeutic uses for the binding protein, and may include enzymes, hormones, and other proteinaceous or non-proteinaceous solutes. In some embodiments, the binding protein will be purified: (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated binding proteins include the binding protein in situ within recombinant cells since at least one component of the binding protein's natural environment will not be present.

The terms "substantially pure" or "substantially purified" as used herein refer to a compound or species that is the predominant species present (i.e., on a molar basis it is more abundant than any other individual species in the composition). In some embodiments, a substantially purified fraction is a composition wherein the species comprises at least about 50% (on a molar basis) of all macromolecular species present. In other embodiments, a substantially pure composition will comprise more than about 80%, 85%, 90%, 95%, or 99% of all macromolar species present in the composition. In still other embodiments, the species is purified to essential homogeneity (contaminant species cannot be detected in the composition by conventional detection methods) wherein the composition consists essentially of a single macromolecular species.

A "neutralizing" binding protein as used herein refers to a molecule that is able to block or substantially reduce an effector function of a target antigen to which it binds. As used herein, "substantially reduce" means at least about 60%, preferably at least about 70%, more preferably at least about 75%, even more preferably at least about 80%, still more preferably at least about 85%, most preferably at least about 90% reduction of an effector function of the target antigen.

The term "epitope" includes any determinant, preferably a polypeptide determinant, capable of specifically binding to an immunoglobulin or T-cell receptor. In certain embodiments, epitope determinants include chemically active surface groupings of molecules such as amino acids, sugar side chains, phosphoryl groups, or sulfonyl groups, and, in certain embodiments, may have specific three-dimensional structural characteristics and/or specific charge characteristics. An epitope is a region of an antigen that is bound by an antibody or binding protein. In certain embodiments, a binding protein is said to specifically bind an antigen when it preferentially recognizes its target antigen in a complex mixture of proteins and/or macromolecules. In some embodiments, a binding protein is said to specifically bind an antigen when the equilibrium dissociation constant is $\leq 10^{-8}$ M, more preferably when the equilibrium dissociation constant is $\leq 10^{-9}$ M, and most preferably when the dissociation constant is $\leq 10^{-10}$ M.

The dissociation constant ($K_D$) of a binding protein can be determined, for example, by surface plasmon resonance. Generally, surface plasmon resonance analysis measures real-time binding interactions between ligand (a target antigen on a biosensor matrix) and analyte (a binding protein in solution) by surface plasmon resonance (SPR) using the BIAcore system (Pharmacia Biosensor; Piscataway, N.J.). Surface plasmon analysis can also be performed by immobilizing the analyte (binding protein on a biosensor matrix) and presenting the ligand (target antigen). The term "$K_D$," as used herein refers to the dissociation constant of the interaction between a particular binding protein and a target antigen.

The term "specifically binds" as used herein refers to the ability of a binding protein or an antigen-binding fragment thereof to bind to an antigen containing an epitope with an Kd of at least about $1 \times 10^{-6}$ M, $1 \times 10^{-7}$ M, $1 \times 10^{-8}$ M, $1 \times 10^{-9}$ M, $1 \times 10^{-10}$ M, $1 \times 10^{-11}$ M, $1 \times 10^{-12}$ M, or more, and/or to bind to an epitope with an affinity that is at least two-fold greater than its affinity for a nonspecific antigen.

The term "linker" as used herein refers to one or more amino acid residues inserted between immunoglobulin domains to provide sufficient mobility for the domains of the light and heavy chains to fold into cross over dual variable region immunoglobulins. A linker is inserted at the transition between variable domains or between variable and constant domains, respectively, at the sequence level. The transition between domains can be identified because the approximate size of the immunoglobulin domains are well understood. The precise location of a domain transition can be determined by locating peptide stretches that do not form secondary structural elements such as beta-sheets or alpha-helices as demonstrated by experimental data or as can be assumed by techniques of modeling or secondary structure prediction. The linkers described herein are referred to as $L_1$, which is located on the light chain between the C-terminus of the $V_{L2}$ and the N-terminus of the $V_{L1}$ domain; and $L_2$, which is located on the light chain between the C-terminus of the $V_{L1}$ and the N-terminus of the $C_L$ domain. The heavy chain linkers are known as $L_3$, which is located between the C-terminus of the $V_{H1}$ and the N-terminus of the $V_{H2}$ domain; and $L_4$, which is located between the C-terminus of the $V_{H2}$ and the N-terminus of the $C_{H1}$ domain.

The term "vector" as used herein refers to any molecule (e.g., nucleic acid, plasmid, or virus) that is used to transfer coding information to a host cell. The term "vector" includes a nucleic acid molecule that is capable of transporting another nucleic acid to which it has been linked. One type of vector is a "plasmid," which refers to a circular double-stranded DNA molecule into which additional DNA segments may be inserted. Another type of vector is a viral vector, wherein additional DNA segments may be inserted into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell and thereby are replicated along with the host genome. In addition, certain vectors are capable of directing the expression of genes to which they are operatively linked. Such vectors are referred to herein as "recombinant expression vectors" (or simply, "expression vectors"). In general, expression vectors of utility in recombinant DNA techniques are often in the form of plasmids. The terms "plasmid" and "vector" may be used interchangeably herein, as a plasmid is the most commonly used form of vector. However, the disclosure is intended to include other forms of expression vectors, such as viral vectors (e.g., replication defective retroviruses, adenoviruses, and adeno-associated viruses), which serve equivalent functions.

The phrase "recombinant host cell" (or "host cell") as used herein refers to a cell into which a recombinant expression vector has been introduced. A recombinant host cell or host cell is intended to refer not only to the particular subject cell, but also to the progeny of such a cell. Because certain modifications may occur in succeeding generations due to either mutation or environmental influences, such progeny may not, in fact, be identical to the parent cell, but such cells are still included within the scope of the term "host cell" as used herein. A wide variety of host cell expression systems can be used to express the binding proteins, including bacterial, yeast, baculoviral, and mammalian expression systems (as well as phage display expression systems). An example of a suitable bacterial expression vector is pUC 19. To express a binding protein recombinantly, a host cell is transformed or transfected with one or more recombinant expression vectors carrying DNA fragments encoding the polypeptide chains of the binding protein such that the polypeptide chains are expressed in the host cell and, preferably, secreted into the medium in which the host cells are cultured, from which medium the binding protein can be recovered.

The term "transformation" as used herein refers to a change in a cell's genetic characteristics, and a cell has been transformed when it has been modified to contain a new DNA. For example, a cell is transformed where it is genetically modified from its native state. Following transformation, the transforming DNA may recombine with that of the cell by physically integrating into a chromosome of the cell, or may be maintained transiently as an episomal element without being replicated, or may replicate independently as a plasmid. A cell is considered to have been stably transformed when the DNA is replicated with the division of the cell. The term "transfection" as used herein refers to the uptake of foreign or exogenous DNA by a cell, and a cell has been "transfected" when the exogenous DNA has been introduced inside the cell membrane. A number of transfection techniques are well known in the art. Such techniques can be used to introduce one or more exogenous DNA molecules into suitable host cells.

The term "naturally occurring" as used herein and applied to an object refers to the fact that the object can be found in nature and has not been manipulated by man. For example, a polynucleotide or polypeptide that is present in an organism (including viruses) that can be isolated from a source in nature and that has not been intentionally modified by man is naturally-occurring. Similarly, "non-naturally occurring" as used herein refers to an object that is not found in nature or that has been structurally modified or synthesized by man.

As used herein, the twenty conventional amino acids and their abbreviations follow conventional usage. Stereoisomers (e.g., D-amino acids) of the twenty conventional amino acids; unnatural amino acids and analogs such as α-, α-di-substituted amino acids, N-alkyl amino acids, lactic acid, and other unconventional amino acids may also be suitable components for the polypeptide chains of the binding proteins. Examples of unconventional amino acids include: 4-hydroxyproline, γ-carboxyglutamate, ε-N,N,N-trimethyllysine, ε-N-acetyllysine, O-phosphoserine, N-acetylserine, N-formylmethionine, 3-methylhistidine, 5-hydroxylysine, σ-N-methylarginine, and other similar amino acids and imino acids (e.g., 4-hydroxyproline). In the polypeptide notation used herein, the left-hand direction is the amino terminal direction and the right-hand direction is the carboxyl-terminal direction, in accordance with standard usage and convention.

Naturally occurring residues may be divided into classes based on common side chain properties:
(1) hydrophobic: Met, Ala, Val, Leu, Ile, Phe, Trp, Tyr, Pro;
(2) polar hydrophilic: Arg, Asn, Asp, Gln, Glu, His, Lys, Ser, Thr;
(3) aliphatic: Ala, Gly, Ile, Leu, Val, Pro;
(4) aliphatic hydrophobic: Ala, Ile, Leu, Val, Pro;
(5) neutral hydrophilic: Cys, Ser, Thr, Asn, Gln;
(6) acidic: Asp, Glu;
(7) basic: His, Lys, Arg;
(8) residues that influence chain orientation: Gly, Pro;
(9) aromatic: His, Trp, Tyr, Phe; and
(10) aromatic hydrophobic: Phe, Trp, Tyr.

Conservative amino acid substitutions may involve exchange of a member of one of these classes with another member of the same class. Non-conservative substitutions may involve the exchange of a member of one of these classes for a member from another class.

A skilled artisan will be able to determine suitable variants of the polypeptide chains of the binding proteins using well-known techniques. For example, one skilled in the art may identify suitable areas of a polypeptide chain that may be changed without destroying activity by targeting regions not believed to be important for activity. Alternatively, one skilled in the art can identify residues and portions of the molecules that are conserved among similar polypeptides. In addition, even areas that may be important for biological activity or for structure may be subject to conservative amino acid substitutions without destroying the biological activity or without adversely affecting the polypeptide structure.

The term "patient" as used herein includes human and animal subjects.

The terms "treatment" or "treat" as used herein refer to both therapeutic treatment and prophylactic or preventative measures. Those in need of treatment include those having the disorder as well as those prone to have a disorder or those in which the disorder is to be prevented. In particular embodiments, binding proteins can be used to treat humans infected with HIV, or humans susceptible to HIV infection, or ameliorate HIV infection in a human subject infected with HIV. The binding proteins can also be used to prevent HIV in a human patient.

It should be understood as that treating humans infected with HIV include those subjects who are at any one of the several stages of HIV infection progression, which, for example, include acute primary infection syndrome (which can be asymptomatic or associated with an influenza-like illness with fevers, malaise, diarrhea and neurologic symptoms such as headache), asymptomatic infection (which is the long latent period with a gradual decline in the number of circulating $CD4^+$ T cells), and AIDS (which is defined by more serious AIDS-defining illnesses and/or a decline in the circulating CD4 cell count to below a level that is compatible with effective immune function). In addition, treating or preventing HIV infection will also encompass treating suspected infection by HIV after suspected past exposure to HIV by e.g., contact with HIV-contaminated blood, blood transfusion, exchange of body fluids, "unsafe" sex with an infected person, accidental needle stick, receiving a tattoo or acupuncture with contaminated instruments, or transmission of the virus from a mother to a baby during pregnancy, delivery or shortly thereafter.

The terms "pharmaceutical composition" or "therapeutic composition" as used herein refer to a compound or composition capable of inducing a desired therapeutic effect when properly administered to a patient.

The term "pharmaceutically acceptable carrier" or "physiologically acceptable carrier" as used herein refers to one or more formulation materials suitable for accomplishing or enhancing the delivery of a binding protein.

The terms "effective amount" and "therapeutically effective amount" when used in reference to a pharmaceutical composition comprising one or more binding proteins refer to an amount or dosage sufficient to produce a desired therapeutic result. More specifically, a therapeutically effective amount is an amount of a binding protein sufficient to inhibit, for some period of time, one or more of the clinically defined pathological processes associated with the condition being treated. The effective amount may vary depending on the specific binding protein that is being used, and also depends on a variety of factors and conditions related to the patient being treated and the severity of the disorder. For example, if the binding protein is to be administered in vivo, factors such as the age, weight, and health of the patient as well as dose response curves and toxicity data obtained in preclinical animal work would be among those factors considered. The determination of an effective amount or therapeutically effective amount of a given pharmaceutical composition is well within the ability of those skilled in the art.

One embodiment of the disclosure provides a pharmaceutical composition comprising a pharmaceutically acceptable carrier and a therapeutically effective amount of a binding protein.

Trispecific and/or Trivalent Binding Proteins

In one embodiment, the binding protein of the disclosure is a trispecific and/or trivalent binding protein comprising four polypeptide chains that form three antigen binding sites that specifically bind one or more (e.g., three different) HIV target proteins, wherein a first polypeptide chain comprises a structure represented by the formula:

$$V_{L2}\text{-}L_1\text{-}V_{L1}\text{-}L_2\text{-}C_L \qquad [I]$$

and a second polypeptide chain comprises a structure represented by the formula:

$$V_{H1}\text{-}L_3\text{-}V_{H2}\text{-}L_4\text{-}C_{H1} \qquad [II]$$

and a third polypeptide chain comprises a structure represented by the formula:

$$V_{H3}\text{-}C_{H1} \qquad [III]$$

and a fourth polypeptide chain comprises a structure represented by the formula:

$$V_{L3}\text{-}C_L \qquad [IV]$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is an immunoglobulin $C_{H1}$ heavy chain constant domain; and
$L_1$, $L_2$, $L_3$ and $L_4$ are amino acid linkers;
and wherein the polypeptide of formula I and the polypeptide of formula II form a cross-over light chain-heavy chain pair.

In one embodiment, the binding protein of the disclosure is a trispecific and/or trivalent binding protein comprising four polypeptide chains that form three antigen binding sites that specifically bind one or more (e.g., three different) HIV target proteins, wherein a first polypeptide chain comprises a structure represented by the formula:

$$V_{L2}\text{-}L_1\text{-}V_{L1}\text{-}L_2\text{-}C_L \qquad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \qquad [II]$$

and a third polypeptide chain comprises a structure represented by the formula:

$$V_{H3}\text{-}C_{H1}\text{-hinge-}C_{H2}\text{-}C_{H3} \qquad [III]$$

and a fourth polypeptide chain comprises a structure represented by the formula:

$$V_{L3}\text{-}C_L \qquad [IV]$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is an immunoglobulin $C_{H1}$ heavy chain constant domain;
$C_{H2}$ is an immunoglobulin $C_{H2}$ heavy chain constant domain;
$C_{H3}$ is an immunoglobulin $C_{H3}$ heavy chain constant domain;
hinge is an immunoglobulin hinge region connecting the $C_{H1}$ and $C_{H2}$ domains; and
$L_1$, $L_2$, $L_3$ and $L_4$ are amino acid linkers;
and wherein the polypeptide of formula I and the polypeptide of formula II form a cross-over light chain-heavy chain pair.

In some embodiments, the first polypeptide chain and the second polypeptide chain have a cross-over orientation that forms two distinct antigen binding sites. In some embodiments, the $V_{H1}$ and $V_{L1}$ form a binding pair and form the first antigen binding site. In some embodiments, the $V_{H2}$ and $V_{L2}$ form a binding pair and form the second antigen binding site. In some embodiments, the third polypeptide and the fourth polypeptide form a third antigen binding site. In some embodiments, the $V_{H3}$ and $V_{L3}$ form a binding pair and form the third antigen binding site.

In some embodiments, $V_{L1}$, $V_{L2}$ and $V_{L3}$ are each independently a variable domain derived from an amino acid sequence as set forth in any one of SEQ ID NOs: 2, 4, 10, 12, 18, 20, 26, 28, 34, 36, 42, 44, 50, 52, 58, 60, 66, 68, 74, 76, 82, 84, 90, 92, 98, 100, 106, 108, 114, 116, 122, 124, 130, 132, 138, 140, 146, 148, 154, 156, 162, 164, 170, 172, 178, 180, 186, 188, 194, 196, 202, 204, 210, 212, 218, 220, 226, 228, 233, 235, 241, 243; and $V_{H1}$, $V_{H2}$ and $V_{H3}$, are each independently a variable domain derived from an amino acid sequence as set forth in any one of SEQ ID NOs:1, 3, 9, 11, 17, 10, 25, 27, 33, 35, 41, 43, 49, 51, 57, 59, 65, 67, 73, 75, 81, 83, 89, 91, 97, 99, 105, 107, 113, 115, 121, 123, 129, 131, 137, 139, 145, 147, 153, 155, 161, 163, 169, 171, 177, 179, 185, 187, 193, 195, 201, 203, 209, 211, 217, 219, 225, 227, 232, 234, 240, 242. In other embodiments, $V_{L1}$, $V_{L2}$ and $V_{L3}$ each independently comprise light chain complementarity determining regions of a variable domain comprising an amino acid sequence as set forth in any one of SEQ ID NOs: 266-283; and $V_{H1}$, $V_{H2}$ and $V_{H3}$ each independently comprise heavy chain complementarity determining regions of a variable domain comprising an amino acid sequence as set forth in any one of SEQ ID NOs: 248-265. In some embodiments, $V_{L1}$, $V_{L2}$ and $V_{L3}$ are each independently a light chain variable domain comprising a light chain variable domain sequence of antibody CD4BS "a", CD4BS "b", MPER, MPER_100W, V1/V2 directed "a", V1/V2 directed "b", or V3 directed described herein. In some embodiments, $V_{H1}$, $V_{H2}$ and $V_{H3}$ are each independently a heavy chain variable domain comprising a heavy chain variable domain sequence of antibody CD4BS "a", CD4BS "b", MPER, MPER_100W, V1/V2 directed "a", V1/V2 directed "b", or V3 directed described herein. In some embodiments, $V_{L1}$, $V_{L2}$ and $V_{L3}$ are each independently a light chain variable domain comprising a CDR-L1, CDR-L2, and CDR-L3 of a light chain variable domain sequence of antibody CD4BS "a", CD4BS "b", MPER, MPER_100W, V1/V2 directed "a", V1/V2 directed "b", or V3 directed described herein. In some embodiments, $V_{H1}$, $V_{H2}$ and $V_{H3}$ are each independently a heavy chain variable domain comprising a CDR-H1, CDR-H2, and CDR-H3 of a heavy chain variable domain sequence of antibody CD4BS "a", CD4BS "b", MPER, MPER_100W, V1/V2 directed "a", V1/V2 directed "b", or V3 directed described herein.

In some embodiments, $V_{L1}$, $V_{L2}$ and $V_{L3}$ are each independently a variable domain derived from an amino acid sequence as set forth in any one of SEQ ID NOs: 303, 305, 311, 313, 319, 321, 327, 329, 335, 337, 343, 345, 351, 353, 359, 361, 367, 369, 375, 377, 383, 385, 391, 393, 399, 401, 407, 409, 415, 417, 423, 425, 431, 433, 439, 441, 447, 449, 455, 457, 463, 465, 471, 473; and $V_{H1}$, $V_{H2}$ and $V_{H3}$, are each independently a variable domain derived from an amino acid sequence as set forth in any one of SEQ ID NOs: 302, 304, 310, 312, 318, 320, 326, 328, 334, 336, 342, 344, 350, 352, 358, 360, 366, 368, 374, 376, 382, 384, 390, 392, 398, 400, 406, 408, 414, 416, 422, 424, 430, 432, 438, 440, 446, 448, 454, 456, 462, 464, 470, 472. In other embodiments, $V_{L1}$, $V_{L2}$ and $V_{L3}$ each independently comprise light chain complementarity determining regions of a variable domain comprising an amino acid sequence as set forth in any one of SEQ ID NOs: 266-271, 275-277, 488-496; and $V_{H1}$, $V_{H2}$ and $V_{H3}$ each independently comprise heavy chain complementarity determining regions of a variable domain comprising an amino acid sequence as set forth in any one of SEQ ID NOs: 248-253, 257-259, 479-487.

In particular embodiments, the order of the $V_{H1}$ and $V_{H2}$ domains, and therefore the order of $V_{L1}$ and $V_{L2}$ domains, in the polypeptide chain of formula I or the polypeptide chain of formula II (i.e., to reverse the order) are swapped.

In some embodiments, the first polypeptide chain comprises the amino acid sequence of SEQ ID NO: 4 or an amino acid sequence that is at least 95% identical to the amino acid sequence of SEQ ID NO: 4; the second polypeptide chain comprises the amino acid sequence of SEQ ID NO: 3 or an amino acid sequence that is at least 95% identical to the amino acid sequence of SEQ ID NO: 3; the third polypeptide chain comprises the amino acid sequence of SEQ ID NO: 1 or an amino acid sequence that is at least 95% identical to the amino acid sequence of SEQ ID NO: 1; and the fourth polypeptide chain comprises the amino acid sequence of SEQ ID NO: 2 or an amino acid sequence that is at least 95% identical to the amino acid sequence of SEQ ID NO: 2.

In some embodiments, the first polypeptide chain comprises the amino acid sequence of SEQ ID NO: 12 or an amino acid sequence that is at least 95% identical to the amino acid sequence of SEQ ID NO: 12; the second polypeptide chain comprises the amino acid sequence of SEQ ID NO: 11 or an amino acid sequence that is at least 95% identical to the amino acid sequence of SEQ ID NO: 11; the third polypeptide chain comprises the amino acid sequence of SEQ ID NO: 9 or an amino acid sequence that is at least 95% identical to the amino acid sequence of SEQ ID NO: 9; and the fourth polypeptide chain comprises the amino acid sequence of SEQ ID NO: 10 or an amino acid sequence that is at least 95% identical to the amino acid sequence of SEQ ID NO: 10.

In other embodiments, the first polypeptide chain comprises the amino acid sequence of SEQ ID NO: 20 or an amino acid sequence that is at least 95% identical to the amino acid sequence of SEQ ID NO: 20; the second polypeptide chain comprises the amino acid sequence of SEQ ID NO: 19 or an amino acid sequence that is at least 95% identical to the amino acid sequence of SEQ ID NO: 19; the third polypeptide chain comprises the amino acid sequence of SEQ ID NO: 17 or an amino acid sequence that is at least 95% identical to the amino acid sequence of SEQ ID NO: 17; and the fourth polypeptide chain comprises the amino acid sequence of SEQ ID NO: 18 or an amino acid sequence that is at least 95% identical to the amino acid sequence of SEQ ID NO: 18.

In other embodiments, the first polypeptide chain comprises the amino acid sequence of SEQ ID NO: 28 or an amino acid sequence that is at least 95% identical to the amino acid sequence of SEQ ID NO: 28; the second polypeptide chain comprises the amino acid sequence of SEQ ID NO: 27 or an amino acid sequence that is at least 95% identical to the amino acid sequence of SEQ ID NO: 27; the third polypeptide chain comprises the amino acid sequence of SEQ ID NO: 25 or an amino acid sequence that is at least 95% identical to the amino acid sequence of SEQ ID NO: 25; and the fourth polypeptide chain comprises the amino acid sequence of SEQ ID NO: 26 or an amino acid sequence that is at least 95% identical to the amino acid sequence of SEQ ID NO: 26.

In other embodiments, the first polypeptide chain comprises the amino acid sequence of SEQ ID NO: 36 or an amino acid sequence that is at least 95% identical to the amino acid sequence of SEQ ID NO: 36; the second polypeptide chain comprises the amino acid sequence of SEQ ID NO: 35 or an amino acid sequence that is at least 95% identical to the amino acid sequence of SEQ ID NO: 35; the third polypeptide chain comprises the amino acid sequence of SEQ ID NO: 33 or an amino acid sequence that is at least 95% identical to the amino acid sequence of SEQ ID NO: 33; and the fourth polypeptide chain comprises the amino acid sequence of SEQ ID NO: 34 or an amino acid sequence that is at least 95% identical to the amino acid sequence of SEQ ID NO: 34.

In other embodiments, the first polypeptide chain comprises the amino acid sequence of SEQ ID NO: 44 or an amino acid sequence that is at least 95% identical to the amino acid sequence of SEQ ID NO: 44; the second polypeptide chain comprises the amino acid sequence of SEQ ID NO: 43 or an amino acid sequence that is at least 95% identical to the amino acid sequence of SEQ ID NO: 43; the third polypeptide chain comprises the amino acid sequence of SEQ ID NO: 41 or an amino acid sequence that is at least 95% identical to the amino acid sequence of SEQ ID NO: 41; and the fourth polypeptide chain comprises the amino acid sequence of SEQ ID NO: 42 or an amino acid sequence that is at least 95% identical to the amino acid sequence of SEQ ID NO: 42.

In other embodiments, the first polypeptide chain comprises the amino acid sequence of SEQ ID NO: 52 or an amino acid sequence that is at least 95% identical to the amino acid sequence of SEQ ID NO: 52; the second polypeptide chain comprises the amino acid sequence of SEQ ID NO: 51 or an amino acid sequence that is at least 95% identical to the amino acid sequence of SEQ ID NO: 51; the third polypeptide chain comprises the amino acid sequence of SEQ ID NO: 49 or an amino acid sequence that is at least 95% identical to the amino acid sequence of SEQ ID NO: 49; and the fourth polypeptide chain comprises the amino acid sequence of SEQ ID NO: 50 or an amino acid sequence that is at least 95% identical to the amino acid sequence of SEQ ID NO: 50.

In other embodiments, the first polypeptide chain comprises the amino acid sequence of SEQ ID NO: 60 or an amino acid sequence that is at least 95% identical to the amino acid sequence of SEQ ID NO: 60; the second polypeptide chain comprises the amino acid sequence of SEQ ID NO: 59 or an amino acid sequence that is at least 95% identical to the amino acid sequence of SEQ ID NO: 59; the third polypeptide chain comprises the amino acid sequence of SEQ ID NO: 57 or an amino acid sequence that is at least 95% identical to the amino acid sequence of SEQ ID NO: 57; and the fourth polypeptide chain comprises the amino acid sequence of SEQ ID NO: 58 or an amino acid sequence that is at least 95% identical to the amino acid sequence of SEQ ID NO: 58.

In other embodiments, the first polypeptide chain comprises the amino acid sequence of SEQ ID NO: 68 or an amino acid sequence that is at least 95% identical to the amino acid sequence of SEQ ID NO: 68; the second polypeptide chain comprises the amino acid sequence of SEQ ID NO: 67 or an amino acid sequence that is at least 95% identical to the amino acid sequence of SEQ ID NO: 67; the third polypeptide chain comprises the amino acid sequence of SEQ ID NO: 65 or an amino acid sequence that is at least 95% identical to the amino acid sequence of SEQ ID NO: 65; and the fourth polypeptide chain comprises the amino acid sequence of SEQ ID NO: 66 or an amino acid sequence that is at least 95% identical to the amino acid sequence of SEQ ID NO: 66.

In other embodiments, the first polypeptide chain comprises the amino acid sequence of SEQ ID NO: 76 or an amino acid sequence that is at least 95% identical to the amino acid sequence of SEQ ID NO: 76; the second polypeptide chain comprises the amino acid sequence of SEQ ID NO: 75 or an amino acid sequence that is at least 95% identical to the amino acid sequence of SEQ ID NO: 75; the third polypeptide chain comprises the amino acid sequence of SEQ ID NO: 73 or an amino acid sequence that is at least 95% identical to the amino acid sequence of SEQ ID NO: 73; and the fourth polypeptide chain comprises the amino acid sequence of SEQ ID NO: 74 or an amino acid sequence that is at least 95% identical to the amino acid sequence of SEQ ID NO: 74.

In other embodiments, the first polypeptide chain comprises the amino acid sequence of SEQ ID NO: 84 or an amino acid sequence that is at least 95% identical to the amino acid sequence of SEQ ID NO: 84; the second polypeptide chain comprises the amino acid sequence of SEQ ID NO: 83 or an amino acid sequence that is at least 95% identical to the amino acid sequence of SEQ ID NO: 83; the third polypeptide chain comprises the amino acid sequence of SEQ ID NO: 81 or an amino acid sequence that is at least 95% identical to the amino acid sequence of SEQ ID NO: 81; and the fourth polypeptide chain comprises the amino acid sequence of SEQ ID NO: 82 or an amino acid sequence that is at least 95% identical to the amino acid sequence of SEQ ID NO: 82.

In other embodiments, the first polypeptide chain comprises the amino acid sequence of SEQ ID NO: 92 or an amino acid sequence that is at least 95% identical to the amino acid sequence of SEQ ID NO:92; the second polypeptide chain comprises the amino acid sequence of SEQ ID NO: 91 or an amino acid sequence that is at least 95% identical to the amino acid sequence of SEQ ID NO: 91; the third polypeptide chain comprises the amino acid sequence of SEQ ID NO: 89 or an amino acid sequence that is at least 95% identical to the amino acid sequence of SEQ ID NO: 89; and the fourth polypeptide chain comprises the amino acid sequence of SEQ ID NO: 90 or an amino acid sequence that is at least 95% identical to the amino acid sequence of SEQ ID NO: 90.

In other embodiments, the first polypeptide chain comprises the amino acid sequence of SEQ ID NO: 100 or an amino acid sequence that is at least 95% identical to the amino acid sequence of SEQ ID NO: 100; the second polypeptide chain comprises the amino acid sequence of SEQ ID NO: 99 or an amino acid sequence that is at least 95% identical to the amino acid sequence of SEQ ID NO: 99; the third polypeptide chain comprises the amino acid sequence of SEQ ID NO: 97 or an amino acid sequence that is at least 95% identical to the amino acid sequence of SEQ ID NO: 97; and the fourth polypeptide chain comprises the amino acid sequence of SEQ ID NO: 98 or an amino acid sequence that is at least 95% identical to the amino acid sequence of SEQ ID NO: 98.

In other embodiments, the first polypeptide comprises the amino acid sequence of SEQ ID NO: 108 or an amino acid sequence that is at least 95% identical to the amino acid sequence of SEQ ID NO: 108; the second polypeptide chain comprises the amino acid sequence of SEQ ID NO: 107 or an amino acid sequence that is at least 95% identical to the amino acid sequence of SEQ ID NO: 107; the third polypeptide chain comprises the amino acid sequence of SEQ ID NO: 105 or an amino acid sequence that is at least 95% identical to the amino acid sequence of SEQ ID NO: 105; and the fourth polypeptide chain comprises the amino acid sequence of SEQ ID NO: 106 or an amino acid sequence that is at least 95% identical to the amino acid sequence of SEQ ID NO: 106.

In other embodiments, the first polypeptide chain comprises the amino acid sequence of SEQ ID NO: 116 or an amino acid sequence that is at least 95% identical to the amino acid sequence of SEQ ID NO: 116; the second polypeptide chain comprises the amino acid sequence of SEQ ID NO: 115 or an amino acid sequence that is at least 95% identical to the amino acid sequence of SEQ ID NO: 115; the third polypeptide chain comprises the amino acid sequence of SEQ ID NO: 113 or an amino acid sequence that is at least 95% identical to the amino acid sequence of SEQ ID NO: 113; and the fourth polypeptide chain comprises the amino acid sequence of SEQ ID NO: 114 or an amino acid sequence that is at least 95% identical to the amino acid sequence of SEQ ID NO: 114.

In other embodiments, the first polypeptide chain comprises the amino acid sequence of SEQ ID NO: 124 or an amino acid sequence that is at least 95% identical to the amino acid sequence of SEQ ID NO: 124; the second polypeptide chain comprises the amino acid sequence of SEQ ID NO: 123 or an amino acid sequence that is at least 95% identical to the amino acid sequence of SEQ ID NO: 123; the third polypeptide chain comprises the amino acid sequence of SEQ ID NO: 121 or an amino acid sequence that is at least 95% identical to the amino acid sequence of SEQ ID NO: 121; and the fourth polypeptide chain comprises the amino acid sequence of SEQ ID NO: 122 or an amino acid sequence that is at least 95% identical to the amino acid sequence of SEQ ID NO: 122.

In other embodiments, the first polypeptide chain comprises the amino acid sequence of SEQ ID NO: 132 or an amino acid sequence that is at least 95% identical to the amino acid sequence of SEQ ID NO: 132; the second polypeptide chain comprises the amino acid sequence of SEQ ID NO: 131 or an amino acid sequence that is at least 95% identical to the amino acid sequence of SEQ ID NO: 131; the third polypeptide chain comprises the amino acid sequence of SEQ ID NO: 129 or an amino acid sequence that is at least 95% identical to the amino acid sequence of SEQ ID NO: 129; and the fourth polypeptide chain comprises the amino acid sequence of SEQ ID NO: 130 or an amino acid sequence that is at least 95% identical to the amino acid sequence of SEQ ID NO: 130.

In other embodiments, the first polypeptide chain comprises the amino acid sequence of SEQ ID NO: 140 or an amino acid sequence that is at least 95% identical to the amino acid sequence of SEQ ID NO: 140; the second polypeptide chain comprises the amino acid sequence of SEQ ID NO: 139 or an amino acid sequence that is at least 95% identical to the amino acid sequence of SEQ ID NO: 139; the third polypeptide chain comprises the amino acid sequence of SEQ ID NO: 137 or an amino acid sequence that is at least 95% identical to the amino acid sequence of SEQ ID NO: 137; and the fourth polypeptide chain comprises the amino acid sequence of SEQ ID NO: 138 or an amino acid sequence that is at least 95% identical to the amino acid sequence of SEQ ID NO: 138.

In other embodiments, the first polypeptide chain comprises the amino acid sequence of SEQ ID NO: 148 or an amino acid sequence that is at least 95% identical to the amino acid sequence of SEQ ID NO: 148; the second polypeptide chain comprises the amino acid sequence of SEQ ID NO: 147 or an amino acid sequence that is at least 95% identical to the amino acid sequence of SEQ ID NO: 147; the third polypeptide chain comprises the amino acid sequence of SEQ ID NO: 145 or an amino acid sequence that is at least 95% identical to the amino acid sequence of SEQ ID NO: 145; and the fourth polypeptide chain comprises the amino acid sequence of SEQ ID NO: 146 or an amino acid sequence that is at least 95% identical to the amino acid sequence of SEQ ID NO: 146.

In other embodiments, the first polypeptide chain comprises the amino acid sequence of SEQ ID NO: 156 or an amino acid sequence that is at least 95% identical to the amino acid sequence of SEQ ID NO: 156; the second polypeptide chain comprises the amino acid sequence of SEQ ID NO: 155 or an amino acid sequence that is at least 95% identical to the amino acid sequence of SEQ ID NO: 155; the third polypeptide chain comprises the amino acid sequence of SEQ ID NO: 153 or an amino acid sequence that is at least 95% identical to the amino acid sequence of SEQ ID NO: 153; and the fourth polypeptide chain comprises the amino acid sequence of SEQ ID NO: 154 or an amino acid sequence that is at least 95% identical to the amino acid sequence of SEQ ID NO: 154.

In other embodiments, the first polypeptide chain comprises the amino acid sequence of SEQ ID NO: 164 or an amino acid sequence that is at least 95% identical to the amino acid sequence of SEQ ID NO: 164; the second polypeptide chain comprises the amino acid sequence of SEQ ID NO: 163 or an amino acid sequence that is at least 95% identical to the amino acid sequence of SEQ ID NO: 163; the third polypeptide chain comprises the amino acid sequence of SEQ ID NO: 161 or an amino acid sequence that is at least 95% identical to the amino acid sequence of SEQ ID NO: 161; and the fourth polypeptide chain comprises the amino acid sequence of SEQ ID NO: 162 or an amino acid sequence that is at least 95% identical to the amino acid sequence of SEQ ID NO: 162.

In other embodiments, the first polypeptide chain comprises the amino acid sequence of SEQ ID NO: 172 or an amino acid sequence that is at least 95% identical to the amino acid sequence of SEQ ID NO: 172; the second polypeptide chain comprises the amino acid sequence of SEQ ID NO: 171 or an amino acid sequence that is at least 95% identical to the amino acid sequence of SEQ ID NO: 171; the third polypeptide chain comprises the amino acid sequence of SEQ ID NO: 169 or an amino acid sequence that is at least 95% identical to the amino acid sequence of SEQ ID NO: 169; and the fourth polypeptide chain comprises the amino acid sequence of SEQ ID NO: 170 or an amino acid sequence that is at least 95% identical to the amino acid sequence of SEQ ID NO: 170.

In other embodiments, the first polypeptide chain comprises the amino acid sequence of SEQ ID NO: 180 or an amino acid sequence that is at least 95% identical to the amino acid sequence of SEQ ID NO: 180; the second polypeptide chain comprises the amino acid sequence of SEQ ID NO: 179 or an amino acid sequence that is at least 95% identical to the amino acid sequence of SEQ ID NO: 179; the third polypeptide chain comprises the amino acid sequence of SEQ ID NO: 177 or an amino acid sequence that is at least 95% identical to the amino acid sequence of SEQ ID NO: 177; and the fourth polypeptide chain comprises the amino acid sequence of SEQ ID NO: 178 or an amino acid sequence that is at least 95% identical to the amino acid sequence of SEQ ID NO: 178.

In other embodiments, the first polypeptide chain comprises the amino acid sequence of SEQ ID NO: 188 or an amino acid sequence that is at least 95% identical to the amino acid sequence of SEQ ID NO: 188; the second polypeptide chain comprises the amino acid sequence of SEQ ID NO: 187 or an amino acid sequence that is at least 95% identical to the amino acid sequence of SEQ ID NO: 187; the third polypeptide chain comprises the amino acid sequence of SEQ ID NO: 185 or an amino acid sequence that is at least 95% identical to the amino acid sequence of SEQ ID NO: 185; and the fourth polypeptide chain comprises the amino acid sequence of SEQ ID NO: 186 or an amino acid sequence that is at least 95% identical to the amino acid sequence of SEQ ID NO: 186.

In other embodiments, the first polypeptide chain comprises the amino acid sequence of SEQ ID NO: 196 or an amino acid sequence that is at least 95% identical to the amino acid sequence of SEQ ID NO: 196; the second polypeptide chain comprises the amino acid sequence of SEQ ID NO: 195 or an amino acid sequence that is at least 95% identical to the amino acid sequence of SEQ ID NO: 195; the third polypeptide chain comprises the amino acid sequence of SEQ ID NO: 193 or an amino acid sequence that is at least 95% identical to the amino acid sequence of SEQ ID NO: 193; and the fourth polypeptide chain comprises the amino acid sequence of SEQ ID NO: 194 or an amino acid sequence that is at least 95% identical to the amino acid sequence of SEQ ID NO: 194.

In other embodiments, the first polypeptide chain comprises the amino acid sequence of SEQ ID NO: 204 or an amino acid sequence that is at least 95% identical to the amino acid sequence of SEQ ID NO: 204; the second polypeptide chain comprises the amino acid sequence of SEQ ID NO: 203 or an amino acid sequence that is at least 95% identical to the amino acid sequence of SEQ ID NO: 203; the third polypeptide chain comprises the amino acid sequence of SEQ ID NO: 201 or an amino acid sequence that is at least 95% identical to the amino acid sequence of SEQ ID NO: 201; and the fourth polypeptide chain comprises the amino acid sequence of SEQ ID NO: 202 or an amino acid sequence that is at least 95% identical to the amino acid sequence of SEQ ID NO: 202.

In other embodiments, the first polypeptide chain comprises the amino acid sequence of SEQ ID NO: 212 or an amino acid sequence that is at least 95% identical to the amino acid sequence of SEQ ID NO: 212; the second polypeptide chain comprises the amino acid sequence of SEQ ID NO: 211 or an amino acid sequence that is at least 95% identical to the amino acid sequence of SEQ ID NO: 211; the third polypeptide chain comprises the amino acid sequence of SEQ ID NO: 209 or an amino acid sequence that is at least 95% identical to the amino acid sequence of SEQ ID NO: 209; and the fourth polypeptide chain comprises the amino acid sequence of SEQ ID NO: 210 or an amino acid sequence that is at least 95% identical to the amino acid sequence of SEQ ID NO: 210.

In other embodiments, the first polypeptide chain comprises the amino acid sequence of SEQ ID NO: 220 or an amino acid sequence that is at least 95% identical to the amino acid sequence of SEQ ID NO: 220; the second polypeptide chain comprises the amino acid sequence of SEQ ID NO: 219 or an amino acid sequence that is at least 95% identical to the amino acid sequence of SEQ ID NO: 219; the third polypeptide chain comprises the amino acid sequence of SEQ ID NO: 217 or an amino acid sequence that is at least 95% identical to the amino acid sequence of SEQ ID NO: 217; and the fourth polypeptide chain comprises the amino acid sequence of SEQ ID NO: 218 or an amino acid sequence that is at least 95% identical to the amino acid sequence of SEQ ID NO: 218.

In other embodiments, the first polypeptide chain comprises the amino acid sequence of SEQ ID NO: 228 or an amino acid sequence that is at least 95% identical to the amino acid sequence of SEQ ID NO: 228; the second polypeptide chain comprises the amino acid sequence of SEQ ID NO: 227 or an amino acid sequence that is at least 95% identical to the amino acid sequence of SEQ ID NO: 227; the third polypeptide chain comprises the amino acid sequence of SEQ ID NO: 225 or an amino acid sequence that is at least 95% identical to the amino acid sequence of SEQ ID NO: 225; and the fourth polypeptide chain comprises the amino acid sequence of SEQ ID NO: 226 or an amino acid sequence that is at least 95% identical to the amino acid sequence of SEQ ID NO: 226.

In other embodiments, the first polypeptide chain comprises the amino acid sequence of SEQ ID NO: 235 or an amino acid sequence that is at least 95% identical to the amino acid sequence of SEQ ID NO: 235; the second polypeptide chain comprises the amino acid sequence of SEQ ID NO: 234 or an amino acid sequence that is at least 95% identical to the amino acid sequence of SEQ ID NO: 234; the third polypeptide chain comprises the amino acid sequence of SEQ ID NO: 232 or an amino acid sequence that is at least 95% identical to the amino acid sequence of SEQ ID NO: 232; and the fourth polypeptide chain comprises the amino acid sequence of SEQ ID NO: 233 or an amino acid sequence that is at least 95% identical to the amino acid sequence of SEQ ID NO: 233.

In other embodiments, the first polypeptide chain comprises the amino acid sequence of SEQ ID NO: 243 or an amino acid sequence that is at least 95% identical to the amino acid sequence of SEQ ID NO: 243; the second polypeptide chain comprises the amino acid sequence of SEQ ID NO: 242 or an amino acid sequence that is at least 95% identical to the amino acid sequence of SEQ ID NO: 242; the third polypeptide chain comprises the amino acid sequence of SEQ ID NO: 240 or an amino acid sequence that is at least 95% identical to the amino acid sequence of SEQ ID NO: 240; and the fourth polypeptide chain comprises the amino acid sequence of SEQ ID NO: 241 or an amino acid sequence that is at least 95% identical to the amino acid sequence of SEQ ID NO: 241.

In another embodiment, the first polypeptide chain comprises the amino acid sequence of SEQ ID NO: 305 or an amino acid sequence that is at least 95% identical to the amino acid sequence of SEQ ID NO: 305; the second polypeptide chain comprises the amino acid sequence of SEQ ID NO: 304 or an amino acid sequence that is at least 95% identical to the amino acid sequence of SEQ ID NO: 304; the third polypeptide chain comprises the amino acid sequence of SEQ ID NO: 302 or an amino acid sequence that is at least 95% identical to the amino acid sequence of SEQ ID NO: 302; and the fourth polypeptide chain comprises the amino acid sequence of SEQ ID NO: 303 or an amino acid sequence that is at least 95% identical to the amino acid sequence of SEQ ID NO: 303.

In another embodiment, the first polypeptide chain comprises the amino acid sequence of SEQ ID NO: 313 or an amino acid sequence that is at least 95% identical to the amino acid sequence of SEQ ID NO: 313; the second polypeptide chain comprises the amino acid sequence of SEQ ID NO: 312 or an amino acid sequence that is at least 95% identical to the amino acid sequence of SEQ ID NO: 312; the third polypeptide chain comprises the amino acid sequence of SEQ ID NO: 310 or an amino acid sequence that is at least 95% identical to the amino acid sequence of SEQ ID NO: 310; and the fourth polypeptide chain comprises the amino acid sequence of SEQ ID NO: 311 or an amino acid sequence that is at least 95% identical to the amino acid sequence of SEQ ID NO: 311.

In another embodiment, the first polypeptide chain comprises the amino acid sequence of SEQ ID NO: 321 or an amino acid sequence that is at least 95% identical to the amino acid sequence of SEQ ID NO: 321; the second polypeptide chain comprises the amino acid sequence of SEQ ID NO: 320 or an amino acid sequence that is at least 95% identical to the amino acid sequence of SEQ ID NO: 320; the third polypeptide chain comprises the amino acid sequence of SEQ ID NO: 318 or an amino acid sequence that is at least 95% identical to the amino acid sequence of SEQ ID NO: 318; and the fourth polypeptide chain comprises the amino acid sequence of SEQ ID NO: 319 or an amino acid sequence that is at least 95% identical to the amino acid sequence of SEQ ID NO: 319.

In another embodiment, the first polypeptide chain comprises the amino acid sequence of SEQ ID NO: 329 or an amino acid sequence that is at least 95% identical to the amino acid sequence of SEQ ID NO: 329; the second polypeptide chain comprises the amino acid sequence of SEQ ID NO: 328 or an amino acid sequence that is at least 95% identical to the amino acid sequence of SEQ ID NO: 328; the third polypeptide chain comprises the amino acid sequence of SEQ ID NO: 326 or an amino acid sequence that is at least 95% identical to the amino acid sequence of SEQ ID NO: 326; and the fourth polypeptide chain comprises the amino acid sequence of SEQ ID NO: 327 or an amino acid sequence that is at least 95% identical to the amino acid sequence of SEQ ID NO: 327.

In another embodiment, the first polypeptide chain comprises the amino acid sequence of SEQ ID NO: 337 or an amino acid sequence that is at least 95% identical to the amino acid sequence of SEQ ID NO: 337; the second polypeptide chain comprises the amino acid sequence of SEQ ID NO: 336 or an amino acid sequence that is at least 95% identical to the amino acid sequence of SEQ ID NO: 336; the third polypeptide chain comprises the amino acid sequence of SEQ ID NO: 334 or an amino acid sequence that is at least 95% identical to the amino acid sequence of SEQ ID NO: 334; and the fourth polypeptide chain comprises the amino acid sequence of SEQ ID NO: 335 or an amino acid sequence that is at least 95% identical to the amino acid sequence of SEQ ID NO: 335.

In another embodiment, the first polypeptide chain comprises the amino acid sequence of SEQ ID NO: 345 or an amino acid sequence that is at least 95% identical to the amino acid sequence of SEQ ID NO: 345; the second polypeptide chain comprises the amino acid sequence of SEQ ID NO: 344 or an amino acid sequence that is at least 95% identical to the amino acid sequence of SEQ ID NO: 344; the third polypeptide chain comprises the amino acid sequence of SEQ ID NO: 342 or an amino acid sequence that is at least 95% identical to the amino acid sequence of SEQ ID NO: 342; and the fourth polypeptide chain comprises the amino acid sequence of SEQ ID NO: 343 or an amino acid sequence that is at least 95% identical to the amino acid sequence of SEQ ID NO: 343.

In another embodiment, the first polypeptide chain comprises the amino acid sequence of SEQ ID NO: 353 or an amino acid sequence that is at least 95% identical to the amino acid sequence of SEQ ID NO: 353; the second polypeptide chain comprises the amino acid sequence of SEQ ID NO: 352 or an amino acid sequence that is at least 95% identical to the amino acid sequence of SEQ ID NO:352; the third polypeptide chain comprises the amino acid sequence of SEQ ID NO: 350 or an amino acid sequence that is at least 95% identical to the amino acid sequence of SEQ ID NO: 350; and the fourth polypeptide chain comprises the amino acid sequence of SEQ ID NO: 351 or an amino acid sequence that is at least 95% identical to the amino acid sequence of SEQ ID NO: 351.

In another embodiment, the first polypeptide chain comprises the amino acid sequence of SEQ ID NO: 361 or an amino acid sequence that is at least 95% identical to the amino acid sequence of SEQ ID NO: 361; the second polypeptide chain comprises the amino acid sequence of SEQ ID NO: 360 or an amino acid sequence that is at least 95% identical to the amino acid sequence of SEQ ID NO: 360; the third polypeptide chain comprises the amino acid sequence of SEQ ID NO: 358 or an amino acid sequence that is at least 95% identical to the amino acid sequence of SEQ ID NO: 358; and the fourth polypeptide chain comprises the amino acid sequence of SEQ ID NO: 359 or an amino acid sequence that is at least 95% identical to the amino acid sequence of SEQ ID NO: 359.

In another embodiment, the first polypeptide chain comprises the amino acid sequence of SEQ ID NO: 369 or an amino acid sequence that is at least 95% identical to the amino acid sequence of SEQ ID NO: 369; the second polypeptide chain comprises the amino acid sequence of SEQ ID NO: 368 or an amino acid sequence that is at least 95% identical to the amino acid sequence of SEQ ID NO: 368; the third polypeptide chain comprises the amino acid sequence of SEQ ID NO: 366 or an amino acid sequence that is at least 95% identical to the amino acid sequence of SEQ ID NO: 366; and the fourth polypeptide chain comprises the amino acid sequence of SEQ ID NO: 367 or an amino acid sequence that is at least 95% identical to the amino acid sequence of SEQ ID NO: 367.

In another embodiment, the first polypeptide chain comprises the amino acid sequence of SEQ ID NO: 377 or an amino acid sequence that is at least 95% identical to the amino acid sequence of SEQ ID NO: 377; the second polypeptide chain comprises the amino acid sequence of SEQ ID NO: 376 or an amino acid sequence that is at least 95% identical to the amino acid sequence of SEQ ID NO: 376; the third polypeptide chain comprises the amino acid sequence of SEQ ID NO: 374 or an amino acid sequence that is at least 95% identical to the amino acid sequence of SEQ ID NO: 374; and the fourth polypeptide chain comprises the amino acid sequence of SEQ ID NO: 375 or an amino acid sequence that is at least 95% identical to the amino acid sequence of SEQ ID NO: 375.

In another embodiment, the first polypeptide chain comprises the amino acid sequence of SEQ ID NO: 385 or an amino acid sequence that is at least 95% identical to the amino acid sequence of SEQ ID NO: 385; the second polypeptide chain comprises the amino acid sequence of SEQ ID NO: 384 or an amino acid sequence that is at least 95% identical to the amino acid sequence of SEQ ID NO: 384; the third polypeptide chain comprises the amino acid sequence of SEQ ID NO: 382 or an amino acid sequence that is at least 95% identical to the amino acid sequence of SEQ ID NO: 382; and the fourth polypeptide chain comprises the amino acid sequence of SEQ ID NO: 383 or an amino acid sequence that is at least 95% identical to the amino acid sequence of SEQ ID NO: 383.

In another embodiment, the first polypeptide chain comprises the amino acid sequence of SEQ ID NO: 393 or an amino acid sequence that is at least 95% identical to the amino acid sequence of SEQ ID NO: 393; the second polypeptide chain comprises the amino acid sequence of SEQ ID NO: 392 or an amino acid sequence that is at least 95% identical to the amino acid sequence of SEQ ID NO: 392; the third polypeptide chain comprises the amino acid sequence of SEQ ID NO: 390 or an amino acid sequence that is at least 95% identical to the amino acid sequence of SEQ ID NO: 390; and the fourth polypeptide chain comprises the amino acid sequence of SEQ ID NO: 391 or an amino acid sequence that is at least 95% identical to the amino acid sequence of SEQ ID NO: 391.

In another embodiment, the first polypeptide chain comprises the amino acid sequence of SEQ ID NO: 401 or an amino acid sequence that is at least 95% identical to the amino acid sequence of SEQ ID NO: 401; the second polypeptide chain comprises the amino acid sequence of SEQ ID NO: 400 or an amino acid sequence that is at least 95% identical to the amino acid sequence of SEQ ID NO: 400; the third polypeptide chain comprises the amino acid sequence of SEQ ID NO: 398 or an amino acid sequence that is at least 95% identical to the amino acid sequence of SEQ ID NO: 398; and the fourth polypeptide chain comprises the amino acid sequence of SEQ ID NO: 399 or an amino acid sequence that is at least 95% identical to the amino acid sequence of SEQ ID NO: 399.

In another embodiment, the first polypeptide chain comprises the amino acid sequence of SEQ ID NO: 409 or an amino acid sequence that is at least 95% identical to the amino acid sequence of SEQ ID NO: 409; the second polypeptide chain comprises the amino acid sequence of SEQ ID NO: 408 or an amino acid sequence that is at least 95% identical to the amino acid sequence of SEQ ID NO: 408; the third polypeptide chain comprises the amino acid sequence of SEQ ID NO: 406 or an amino acid sequence that is at least 95% identical to the amino acid sequence of SEQ ID NO: 406; and the fourth polypeptide chain comprises the amino acid sequence of SEQ ID NO: 407 or an amino acid sequence that is at least 95% identical to the amino acid sequence of SEQ ID NO: 407.

In another embodiment, the first polypeptide chain comprises the amino acid sequence of SEQ ID NO: 417 or an amino acid sequence that is at least 95% identical to the amino acid sequence of SEQ ID NO: 417; the second polypeptide chain comprises the amino acid sequence of SEQ ID NO: 416 or an amino acid sequence that is at least 95% identical to the amino acid sequence of SEQ ID NO: 416; the third polypeptide chain comprises the amino acid sequence of SEQ ID NO: 414 or an amino acid sequence that is at least 95% identical to the amino acid sequence of SEQ ID NO: 414; and the fourth polypeptide chain comprises the amino acid sequence of SEQ ID NO: 415 or an amino acid sequence that is at least 95% identical to the amino acid sequence of SEQ ID NO: 415.

In another embodiment, the first polypeptide chain comprises the amino acid sequence of SEQ ID NO: 425 or an amino acid sequence that is at least 95% identical to the amino acid sequence of SEQ ID NO: 425; the second polypeptide chain comprises the amino acid sequence of SEQ ID NO: 424 or an amino acid sequence that is at least 95% identical to the amino acid sequence of SEQ ID NO: 424; the third polypeptide chain comprises the amino acid sequence of SEQ ID NO: 422 or an amino acid sequence that is at least 95% identical to the amino acid sequence of SEQ ID NO: 422; and the fourth polypeptide chain comprises the amino acid sequence of SEQ ID NO: 423 or an amino acid sequence that is at least 95% identical to the amino acid sequence of SEQ ID NO: 423.

In another embodiment, the first polypeptide chain comprises the amino acid sequence of SEQ ID NO: 433 or an amino acid sequence that is at least 95% identical to the amino acid sequence of SEQ ID NO:433; the second polypeptide chain comprises the amino acid sequence of SEQ ID NO: 432 or an amino acid sequence that is at least 95% identical to the amino acid sequence of SEQ ID NO: 432; the third polypeptide chain comprises the amino acid sequence of SEQ ID NO: 430 or an amino acid sequence that is at least 95% identical to the amino acid sequence of SEQ ID NO: 430; and the fourth polypeptide chain comprises the amino acid sequence of SEQ ID NO: 431 or an amino acid sequence that is at least 95% identical to the amino acid sequence of SEQ ID NO: 431.

In another embodiment, the first polypeptide chain comprises the amino acid sequence of SEQ ID NO: 441 or an amino acid sequence that is at least 95% identical to the amino acid sequence of SEQ ID NO: 441; the second polypeptide chain comprises the amino acid sequence of SEQ ID NO: 440 or an amino acid sequence that is at least 95% identical to the amino acid sequence of SEQ ID NO: 440; the third polypeptide chain comprises the amino acid sequence of SEQ ID NO: 438 or an amino acid sequence that is at least 95% identical to the amino acid sequence of SEQ ID NO: 438; and the fourth polypeptide chain comprises the amino acid sequence of SEQ ID NO: 439 or an amino acid sequence that is at least 95% identical to the amino acid sequence of SEQ ID NO: 439.

In another embodiment, the first polypeptide chain comprises the amino acid sequence of SEQ ID NO: 449 or an amino acid sequence that is at least 95% identical to the amino acid sequence of SEQ ID NO: 449; the second polypeptide chain comprises the amino acid sequence of SEQ ID NO: 448 or an amino acid sequence that is at least 95% identical to the amino acid sequence of SEQ ID NO: 448; the third polypeptide chain comprises the amino acid sequence of SEQ ID NO: 446 or an amino acid sequence that is at least 95% identical to the amino acid sequence of SEQ ID NO: 446; and the fourth polypeptide chain comprises the amino acid sequence of SEQ ID NO: 447 or an amino acid sequence that is at least 95% identical to the amino acid sequence of SEQ ID NO: 447.

In another embodiment, the first polypeptide chain comprises the amino acid sequence of SEQ ID NO: 457 or an amino acid sequence that is at least 95% identical to the amino acid sequence of SEQ ID NO: 457; the second polypeptide chain comprises the amino acid sequence of SEQ ID NO: 456 or an amino acid sequence that is at least 95% identical to the amino acid sequence of SEQ ID NO: 456; the third polypeptide chain comprises the amino acid sequence of SEQ ID NO: 454 or an amino acid sequence that is at least 95% identical to the amino acid sequence of SEQ ID NO: 454; and the fourth polypeptide chain comprises the amino acid sequence of SEQ ID NO: 455 or an amino acid sequence that is at least 95% identical to the amino acid sequence of SEQ ID NO: 455.

In another embodiment, the first polypeptide chain comprises the amino acid sequence of SEQ ID NO: 465 or an amino acid sequence that is at least 95% identical to the amino acid sequence of SEQ ID NO: 465; the second polypeptide chain comprises the amino acid sequence of SEQ ID NO: 464 or an amino acid sequence that is at least 95% identical to the amino acid sequence of SEQ ID NO: 464; the third polypeptide chain comprises the amino acid sequence of SEQ ID NO: 462 or an amino acid sequence that is at least 95% identical to the amino acid sequence of SEQ ID NO: 462; and the fourth polypeptide chain comprises the amino acid sequence of SEQ ID NO: 463 or an amino acid sequence that is at least 95% identical to the amino acid sequence of SEQ ID NO: 463.

In another embodiment, the first polypeptide chain comprises the amino acid sequence of SEQ ID NO: 473 or an amino acid sequence that is at least 95% identical to the amino acid sequence of SEQ ID NO: 473; the second polypeptide chain comprises the amino acid sequence of SEQ ID NO: 472 or an amino acid sequence that is at least 95% identical to the amino acid sequence of SEQ ID NO: 472; the third polypeptide chain comprises the amino acid sequence of SEQ ID NO: 470 or an amino acid sequence that is at least 95% identical to the amino acid sequence of SEQ ID NO: 470; and the fourth polypeptide chain comprises the amino acid sequence of SEQ ID NO: 471 or an amino acid sequence that is at least 95% identical to the amino acid sequence of SEQ ID NO: 471.

In other embodiments, the binding protein of the disclosure is a trispecific and/or trivalent binding protein comprising four polypeptide chains that form three antigen binding sites that specifically bind one or more (e.g., three) HIV target antigens, wherein a first polypeptide chain has a structure represented by the formula:

$$V_{L2}\text{-}L_1\text{-}V_{L1}\text{-}L_2\text{-}C_L \quad [I]$$

and a second polypeptide chain has a structure represented by the formula:

$$V_{H1}\text{-}L_3\text{-}V_{H2}\text{-}L_4\text{-}C_{H1}\text{-}\text{hinge-}C_{H2}\text{-}C_{H3} \text{ (hole)} \quad [II]$$

and a third polypeptide chain has a structure represented by the formula:

$$V_{H3}\text{-}C_{H1}\text{-}\text{hinge-}C_{H2}\text{-}C_{H3} \text{ (knob)} \quad [III]$$

and a fourth polypeptide chain has a structure represented by the formula:

$$V_{L3}\text{-}C_L \quad [IV]$$

wherein:

$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$ and $L_4$ are amino acid linkers;
and wherein the polypeptide of formula I and the polypeptide of formula II form a cross-over light chain-heavy chain pair.

In other embodiments, the binding protein of the disclosure is a trispecific and/or trivalent binding protein comprising four polypeptide chains that form three antigen binding sites that specifically bind one or more (e.g., three) HIV target antigens, wherein a first polypeptide chain has a structure represented by the formula:

$$V_{L2}\text{-}L_1\text{-}V_{L1}\text{-}L_2\text{-}C_L \quad [I]$$

and a second polypeptide chain has a structure represented by the formula:

$$V_{H1}\text{-}L_3\text{-}V_{H2}\text{-}L_4\text{-}C_{H1}\text{-}\text{hinge-}C_{H2}\text{-}C_{H3} \text{ (knob)} \quad [II]$$

and a third polypeptide chain has a structure represented by the formula:

$$V_{H3}\text{-}C_{H1}\text{-}\text{hinge-}C_{H2}\text{-}C_{H3} \text{ (hole)} \quad [III]$$

and a fourth polypeptide chain has a structure represented by the formula:

$$V_{L3}\text{-}C_L \quad [IV]$$

wherein:

$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$ and $L_4$ are amino acid linkers;
and wherein the polypeptide of formula I and the polypeptide of formula II form a cross-over light chain-heavy chain pair.

Additional Examples of Trispecific Binding Proteins

In some embodiments, $V_{L1}$, $V_{L2}$ and $V_{L3}$ are each independently a variable domain comprising an amino acid sequence as set forth in any one of SEQ ID NOs: 512, 513, 514, 515, 516, 517, 518, 519, 520, and 521. In some embodiments, $V_{L1}$, $V_{L2}$ and $V_{L3}$ are each independently a variable domain comprising an amino acid sequence having at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, or at least about 99% sequence identity to a sequence as set forth in any one of SEQ ID NOs: 512, 513, 514, 515, 516, 517, 518, 519, 520, and 521.

In some embodiments, $V_{H1}$, $V_{H2}$ and $V_{H3}$ are each independently a variable domain comprising an amino acid sequence as set forth in any one of SEQ ID NOs: 502, 503, 504, 505, 506, 507, and 508. In some embodiments, $V_{H1}$, $V_{H2}$ and $V_{H3}$ are each independently a variable domain comprising an amino acid sequence having at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, or at least about 99% sequence identity to a sequence as set forth in any one of SEQ ID NOs: 502, 503, 504, 505, 506, 507, and 508.

In some embodiments, $V_{L1}$, $V_{L2}$, and $V_{L3}$ comprise an amino acid sequence as set forth in SEQ ID NOs: 518, 519, and 512, respectively, and $V_{H1}$, $V_{H2}$, and $V_{H3}$ comprise an amino acid sequence as set forth in SEQ ID NOs: 504, 506, and 502, respectively. In some embodiments, $V_{L1}$, $V_{L2}$, and $V_{L3}$ comprise an amino acid sequence as set forth in SEQ ID NOs: 518, 519, and 513, respectively, and $V_{H1}$, $V_{H2}$, and $V_{H3}$ comprises an amino acid sequence as set forth in SEQ ID NOs: 504, 506, and 503, respectively. In some embodiments, $V_{L1}$, $V_{L2}$, and $V_{L3}$ comprises an amino acid sequence as set forth in SEQ ID NOs: 519, 518, and 513, respectively, and $V_{H1}$, $V_{H2}$, and $V_{H3}$ comprises an amino acid sequence as set forth in SEQ ID NOs: 506, 504, and 503, respectively.

In some embodiments, $V_{L1}$, $V_{L2}$ and $V_{L3}$ are each independently a variable domain comprising a CDR-L1, CDR- L2, and CDR-L3 of a light chain variable domain comprising a sequence selected from the group consisting of SEQ ID NOs: 512, 513, 514, 515, 516, 517, 518, 519, 520, and 521. In some embodiments, $V_{H1}$, $V_{H2}$ and $V_{H3}$ are each independently a variable domain comprising a CDR-H1, CDR-H2, and CDR-H3 of a heavy chain variable domain comprising a sequence selected from the group consisting of SEQ ID NOs: 502, 503, 504, 505, 506, 507, and 508. In some embodiments, $V_{L1}$, $V_{L2}$ and $V_{L3}$ are each independently a variable domain comprising a CDR-L1, CDR-L2, and CDR-L3 of a light chain variable domain comprising a light chain variable domain sequence shown in Table C. In some embodiments, $V_{H1}$, $V_{H2}$ and $V_{H3}$ are each independently a variable domain comprising a CDR-H1, CDR-H2, and CDR-H3 of a heavy chain variable domain comprising a heavy chain variable domain sequence shown in Table C.

In some embodiments, $V_{L1}$ is a variable domain comprising a CDR-L1, CDR-L2, and CDR-L3 of a light chain variable domain comprising a sequence of SEQ ID NO: 518, $V_{L2}$ is a variable domain comprising a CDR-L1, CDR-L2, and CDR-L3 of a light chain variable domain comprising a sequence of SEQ ID NO: 519, $V_{L3}$ is a variable domain comprising a CDR-L1, CDR-L2, and CDR-L3 of a light chain variable domain comprising a sequence of SEQ ID NO: 512, $V_{H1}$ is a variable domain comprising a CDR-H1, CDR-H2, and CDR-H3 of a heavy chain variable domain comprising a sequence of SEQ ID NO: 504, $V_{H2}$ is a variable domain comprising a CDR-H1, CDR-H2, and CDR-H3 of a heavy chain variable domain comprising a sequence of SEQ ID NO: 506, and $V_{H3}$ is a variable domain comprising a CDR-H1, CDR-H2, and CDR-H3 of a heavy chain variable domain comprising a sequence of SEQ ID NO: 502. In some embodiments, $V_{L1}$ is a variable domain comprising a CDR-L1, CDR-L2, and CDR-L3 of a light chain variable domain comprising a sequence of SEQ ID NO: 518, $V_{L2}$ is a variable domain comprising a CDR-L1, CDR-L2, and CDR-L3 of a light chain variable domain comprising a sequence of SEQ ID NO: 519, $V_{L3}$ is a variable domain comprising a CDR-L1, CDR-L2, and CDR-L3 of a light chain variable domain comprising a sequence of SEQ ID NO: 513, $V_{H1}$ is a variable domain comprising a CDR-H1, CDR-H2, and CDR-H3 of a heavy chain variable domain comprising a sequence of SEQ ID NO: 504, $V_{H2}$ is a variable domain comprising a CDR-H1, CDR-H2, and CDR-H3 of a heavy chain variable domain comprising a sequence of SEQ ID NO: 506, and $V_{H3}$ is a variable domain comprising a CDR-H1, CDR-H2, and CDR-H3 of a heavy chain variable domain comprising a sequence of SEQ ID NO: 503. In some embodiments, $V_{L1}$ is a variable domain comprising a CDR-L1, CDR-L2, and CDR-L3 of a light chain variable domain comprising a sequence of SEQ ID NO: 519, $V_{L2}$ is a variable domain comprising a CDR-L1, CDR-L2, and CDR-L3 of a light chain variable domain comprising a sequence of SEQ ID NO: 518, $V_{L3}$ is a variable domain comprising a CDR-L1, CDR-L2, and CDR-L3 of a light chain variable domain comprising a sequence of SEQ ID NO: 513, and $V_{H1}$ is a variable domain comprising a CDR-H1, CDR-H2, and CDR-H3 of a heavy chain variable domain comprising a sequence of SEQ ID NO: 506, $V_{H2}$ is a variable domain comprising a CDR-H1, CDR-H2, and CDR-H3 of a heavy chain variable domain comprising a sequence of SEQ ID NO: 504, and $V_{H3}$ is a variable domain comprising a CDR-H1, CDR-H2, and CDR-H3 of a heavy chain variable domain comprising a sequence of SEQ ID NO: 503.

In some embodiments, $V_{L1}$, $V_{L2}$ and $V_{L3}$ are each independently a variable domain comprising: (a) a CDR-L1 comprising a sequence selected from the group consisting of SEQ ID NOs: 266, 269, 275, 278, 281, and 500; (b) a CDR-L2 comprising a sequence selected from the group consisting of SEQ ID NOs: 267, 270, 276, 279, 282, and 501; and/or (c) a CDR-L3 comprising a sequence selected from the group consisting of SEQ ID NOs: 268, 271, 274, 277, 280, and 283. In some embodiments, $V_{L1}$, $V_{L2}$ and $V_{L3}$ are each independently a variable domain comprising a CDR-L1, CDR-L2, and CDR-L3 comprising amino acid sequences as shown in Table B. In some embodiments, $V_{L1}$, $V_{L2}$ and $V_{L3}$ are each independently a variable domain comprising a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; or a sequence as set forth in SEQ ID NOs: 278, 279, and 280, respectively.

In some embodiments, $V_{H1}$, $V_{H2}$ and $V_{H3}$ are each independently a variable domain comprising: (a) a CDR-H1 comprising a sequence selected from the group consisting of SEQ ID NOs: 248, 251, 254, 257, 263, and 499; (b) a CDR-H2 comprising a sequence selected from the group consisting of SEQ ID NOs: 252, 255, 258, 261, 264, and 497; and/or (c) a CDR-H3 comprising a sequence selected from the group consisting of SEQ ID NOs: 250, 253, 256, 259, 262, 265, and 498. In some embodiments, $V_{H1}$, $V_{H2}$ and $V_{H3}$ are each independently a variable domain comprising a CDR-H1, CDR-H2, and CDR-H3 comprising amino acid sequences as shown in Table B. In some embodiments, $V_{H1}$, $V_{H2}$ and $V_{H3}$ are each independently a variable domain comprising a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; or a sequence as set forth in SEQ ID NOs: 499, 261, and 262, respectively.

In some embodiments, $V_{L1}$ comprises a CDR-L1, CDR-L2, and CDR-L3 comprising the sequence of SEQ ID NOs: 500, 501, and 274, respectively; $V_{L2}$ comprises a CDR-L1, CDR-L2, and CDR-L3 comprising the sequence of SEQ ID NOs: 275, 276, and 277, respectively; $V_{L3}$ comprises a CDR-L1, CDR-L2, and CDR-L3 comprising the sequence of SEQ ID NOs: 266, 267, and 268, respectively; $V_{H1}$ comprises a CDR-H1, CDR-H2, and CDR-H3 comprising the sequence of SEQ ID NOs: 254, 255, and 256, respectively; $V_{H2}$ comprises a CDR-H1, CDR-H2, and CDR-H3 comprising the sequence of SEQ ID NOs: 257, 258, and 259, respectively; and $V_{H3}$ comprises a CDR-H1, CDR-H2, and CDR-H3 comprising the sequence of SEQ ID NOs: 248, 497, and 250, respectively. In some embodiments, $V_{L1}$ comprises a CDR-L1, CDR-L2, and CDR-L3 comprising the sequence of SEQ ID NOs: 500, 501, and 274, respectively; $V_{L2}$ comprises a CDR-L1, CDR-L2, and CDR-L3 comprising the sequence of SEQ ID NOs: 275, 276, and 277, respectively; $V_{L3}$ comprises a CDR-L1, CDR-L2, and CDR-L3 comprising the sequence of SEQ ID NOs: 269, 270, and 271, respectively; $V_{H1}$ comprises a CDR-H1, CDR-H2, and CDR-H3 comprising the sequence of SEQ ID NOs: 254, 255, and 256, respectively; $V_{H2}$ comprises a CDR-H1, CDR-H2, and CDR-H3 comprising the sequence of SEQ ID NOs: 257, 258, and 259, respectively; and $V_{H3}$ comprises a CDR-H1, CDR-H2, and CDR-H3 comprising the sequence of SEQ ID NOs: 251, 252, and 253, respectively. In some embodiments, $V_{L1}$ comprises a CDR-L1, CDR-L2, and CDR-L3 comprising the sequence of SEQ ID NOs: 275, 276, and 277, respectively; $V_{L2}$ comprises a CDR-L1, CDR-L2, and CDR-L3 comprising the sequence of SEQ ID NOs: 500, 501, and 274, respectively; $V_{L3}$ comprises a CDR-L1, CDR-L2, and CDR-L3 comprising the sequence of SEQ ID NOs: 269, 270, and 271, respectively; $V_{H1}$ comprises a CDR-H1, CDR-H2, and CDR-H3 comprising the sequence of SEQ ID NOs: 257, 258, and 259, respectively; $V_{H2}$ comprises a CDR-H1, CDR-H2, and CDR-H3 comprising the sequence of SEQ ID NOs: 254, 255, and 256, respectively; and $V_{H3}$ comprises a CDR-H1, CDR-H2, and CDR-H3 comprising the sequence of SEQ ID NOs: 251, 252, and 253, respectively.

Additional Trispecific Binding Proteins Targeting One or More HIV Target Proteins and One or More T Cell Target Proteins In some embodiments, a binding protein of the present disclosure comprises four polypeptide chains that form three antigen binding sites that specifically bind one or more (e.g., one or two) HIV target proteins and one or more (e.g., one or two) T cell target proteins, wherein a first polypeptide chain has a structure represented by the formula:

$$V_{L2}\text{-}L_1\text{-}V_{L1}\text{-}L_2\text{-}C_L \qquad [I];$$

a second polypeptide chain has a structure represented by the formula:

$$V_{H1}\text{-}L_3\text{-}V_{H2}\text{-}L_4\text{-}C_{H1} \qquad [II];$$

a third polypeptide chain has a structure represented by the formula:

$$V_{H3}\text{-}C_{H1} \qquad [III];$$

and a fourth polypeptide chain has a structure represented by the formula:

$$V_{L3}\text{-}C_L \qquad [IV];$$

wherein
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is an immunoglobulin $C_{H1}$ heavy chain constant domain; and
$L_1$, $L_2$, $L_3$, and $L_4$ are amino acid linkers;
and wherein the polypeptide of formula I and the polypeptide of formula II form a cross-over light chain-heavy chain pair.

In some embodiments, a binding protein of the present disclosure comprises four polypeptide chains that form three antigen binding sites that specifically bind one or more (e.g., one or two) HIV target proteins and one or more (e.g., one or two) T cell target proteins, wherein a first polypeptide chain has a structure represented by the formula:

$$V_{L2}\text{-}L_1\text{-}V_{L1}\text{-}L_2\text{-}C_L \qquad [I];$$

a second polypeptide chain has a structure represented by the formula:

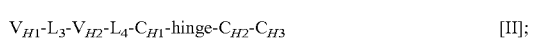

$$V_{H1}\text{-}L_3\text{-}V_{H2}\text{-}L_4\text{-}C_{H1}\text{-hinge-}C_{H2}\text{-}C_{H3} \qquad [II];$$

a third polypeptide chain has a structure represented by the formula:

$$V_{H3}\text{-}C_{H1}\text{-hinge-}C_{H2}\text{-}C_{H3} \qquad [III];$$

and a fourth polypeptide chain has a structure represented by the formula

$$V_{L3}\text{-}C_L \qquad [IV];$$

wherein
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is an immunoglobulin $C_{H1}$ heavy chain constant domain;
$C_{H2}$ is an immunoglobulin $C_{H2}$ heavy chain constant domain;
$C_{H3}$ is an immunoglobulin $C_{H3}$ heavy chain constant domain;
hinge is an immunoglobulin hinge region connecting the $C_{H1}$ and $C_{H2}$ domains; and
$L_1$, $L_2$, $L_3$, and $L_4$ are amino acid linkers;
and wherein the polypeptide of formula I and the polypeptide of formula II form a cross-over light chain-heavy chain pair.

In some embodiments, the first polypeptide chain and the second polypeptide chain have a cross-over orientation that forms two distinct antigen binding sites. In some embodiments, the $V_{H1}$ and $V_{L1}$ form a binding pair and form the first antigen binding site. In some embodiments, the $V_{H2}$ and $V_{L2}$ form a binding pair and form the second antigen binding site. In some embodiments, the third polypeptide and the fourth polypeptide form a third antigen binding site. In some embodiments, the $V_{H3}$ and $V_{L3}$ form a binding pair and form the third antigen binding site.

In some embodiments, $V_{L1}$, $V_{L2}$ and $V_{L3}$ are each independently a variable domain comprising an amino acid sequence as set forth in any one of SEQ ID NOs: 512, 513, 514, 515, 516, 517, 518, 519, 520, 521, 522, 523, and 524. In some embodiments, $V_{L1}$, $V_{L2}$ and $V_{L3}$ are each independently a variable domain comprising an amino acid sequence having at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, or at least about 99% sequence identity to a sequence as set forth in any one of SEQ ID NOs: 512, 513, 514, 515, 516, 517, 518, 519, 520, 521, 522, 523, and 524.

In some embodiments, $V_{H1}$, $V_{H2}$ and $V_{H3}$ are each independently a variable domain comprising an amino acid sequence as set forth in any one of SEQ ID NOs: 502, 503, 504, 505, 506, 507, 508, 509, 510, and 511. In some embodiments, $V_{H1}$, $V_{H2}$ and $V_{H3}$ are each independently a variable domain comprising an amino acid sequence having at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, or at least about 99% sequence identity to a sequence as set forth in any one of SEQ ID NOs: 502, 503, 504, 505, 506, 507, 508, 509, 510, and 511.

In some embodiments, $V_{L1}$, $V_{L2}$, and $V_{L3}$ comprise an amino acid sequence as set forth in SEQ ID NOs: 522, 524, and 513, respectively, and $V_{H1}$, $V_{H2}$, and $V_{H3}$ comprise an amino acid sequence as set forth in SEQ ID NOs: 509, 511, and 503, respectively. In some embodiments, $V_{L1}$, $V_{L2}$, and $V_{L3}$ comprise an amino acid sequence as set forth in SEQ ID NOs: 524, 522, and 513, respectively, and $V_{H1}$, $V_{H2}$, and $V_{H3}$ comprise an amino acid sequence as set forth in SEQ ID NOs: 511, 509, and 503, respectively.

In some embodiments, $V_{L1}$, $V_{L2}$ and $V_{L3}$ are each independently a variable domain comprising a CDR-L1, CDR-L2, and CDR-L3 of a light chain variable domain comprising a sequence selected from the group consisting of SEQ ID NOs: 512, 513, 514, 515, 516, 517, 518, 519, 520, 521, 522, 523, and 524.

In some embodiments, $V_{H1}$, $V_{H2}$ and $V_{H3}$ are each independently a variable domain comprising a CDR-H1, CDR-H2, and CDR-H3 of a heavy chain variable domain comprising a sequence selected from the group consisting of SEQ ID NOs: 502, 503, 504, 505, 506, 507, 508, 509, 510, and 511.

In some embodiments, $V_{L1}$ is a variable domain comprising a CDR-L1, CDR-L2, and CDR-L3 of a light chain variable domain comprising a sequence of SEQ ID NO: 522, $V_{L2}$ is a variable domain comprising a CDR-L1, CDR-L2, and CDR-L3 of a light chain variable domain comprising a sequence of SEQ ID NO: 524, $V_{L3}$ is a variable domain comprising a CDR-L1, CDR-L2, and CDR-L3 of a light chain variable domain comprising a sequence of SEQ ID NO: 513, $V_{H1}$ is a variable domain comprising a CDR-H1, CDR-H2, and CDR-H3 of a heavy chain variable domain comprising a sequence of SEQ ID NO: 509, $V_{H2}$ is a variable domain comprising a CDR-H1, CDR-H2, and CDR-H3 of a heavy chain variable domain comprising a sequence of SEQ ID NO: 511, and $V_{H3}$ is a variable domain comprising a CDR-H1, CDR-H2, and CDR-H3 of a heavy chain variable domain comprising a sequence of SEQ ID NO: 503. In some embodiments, $V_{L1}$ is a variable domain comprising a CDR-L1, CDR-L2, and CDR-L3 of a light chain variable domain comprising a sequence of SEQ ID NO: 524, $V_{L2}$ is a variable domain comprising a CDR-L1, CDR-L2, and CDR-L3 of a light chain variable domain comprising a sequence of SEQ ID NO: 522, $V_{L3}$ is a variable domain comprising a CDR-L1, CDR-L2, and CDR-L3 of a light chain variable domain comprising a light chain variable domain sequence of SEQ ID NO: 513, $V_{H1}$ is a variable domain comprising a CDR-H1, CDR-H2, and CDR-H3 of a heavy chain variable domain comprising a sequence of SEQ ID NO: 511, $V_{H2}$ is a variable domain comprising a CDR-H1, CDR-H2, and CDR-H3 of a heavy chain variable domain comprising a sequence of SEQ ID NO: 509, and $V_{H3}$ is a variable domain comprising a CDR-H1, CDR-H2, and CDR-H3 of a heavy chain variable domain comprising a sequence of SEQ ID NO: 503.

In some embodiments, $V_{L1}$, $V_{L2}$ and $V_{L3}$ are each independently a variable domain comprising: (a) a CDR-L1 comprising a sequence selected from the group consisting of SEQ ID NOs: 266, 269, 275, 278, 281, 488, 491, 494 and 500; (b) a CDR-L2 comprising a sequence selected from the group consisting of SEQ ID NOs: 267, 270, 276, 279, 282, 489, 492, 495, and 501; and (c) a CDR-L3 comprising a sequence selected from the group consisting of SEQ ID NOs: 268, 271, 274, 277, 280, 283, 490, 493, and 496. In some embodiments, $V_{L1}$, $V_{L2}$ and $V_{L3}$ are each independently a variable domain comprising a CDR-L1, CDR-L2, and CDR-L3 comprising amino acid sequences as shown in Table B. In some embodiments, $V_{L1}$, $V_{L2}$ and $V_{L3}$ are each independently a variable domain comprising a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; a sequence as set forth in SEQ ID NOs: 278, 279, and 280, respectively; a sequence as set forth in SEQ ID NOs: 488, 489, and 490, respectively; a sequence as set forth in SEQ ID NOs: 491, 492, and 493, respectively; or a sequence as set forth in SEQ ID NOs: 494, 495, and 496, respectively.

In some embodiments, $V_{H1}$, $V_{H2}$ and $V_{H3}$ are each independently a variable domain comprising: (a) a CDR-H1 comprising a sequence selected from the group consisting of SEQ ID NOs: 248, 251, 254, 257, 263, 479, 482, 485, and 499; (b) a CDR-H2 comprising a sequence selected from the group consisting of SEQ ID NOs: 252, 255, 258, 261, 264, 480, 483, 486, and 497; and (c) a CDR-H3 comprising a sequence selected from the group consisting of SEQ ID NOs: 250, 253, 256, 259, 262, 265, 481, 484, 487, and 498. In some embodiments, $V_{H1}$, $V_{H2}$ and $V_{H3}$ are each independently a variable domain comprising a CDR-H1, CDR-H2, and CDR-H3 comprising amino acid sequences as shown in Table B. In some embodiments, $V_{H1}$, $V_{H2}$ and $V_{H3}$ are each independently a variable domain comprising a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; a sequence as set forth in SEQ ID NOs: 499, 261, and 262, respectively; a sequence as set forth in SEQ ID NOs: 479, 480, and 481, respectively; a sequence as set forth in SEQ ID NOs: 482, 483, and 484, respectively; or a sequence as set forth in SEQ ID NOs: 485, 486, and 487, respectively.

In some embodiments, $V_{L1}$ comprises a CDR-L1, CDR-L2, and CDR-L3 comprising the sequence of SEQ ID NOs: 488, 489, and 490, respectively; $V_{L2}$ comprises a CDR-L1, CDR-L2, and CDR-L3 comprising the sequence of SEQ ID NOs: 494, 495, and 496, respectively; $V_{L3}$ comprises a CDR-L1, CDR-L2, and CDR-L3 comprising the sequence of SEQ ID NOs: 269, 270, and 271, respectively; $V_{H1}$ comprises a CDR-H1, CDR-H2, and CDR-H3 comprising the sequence of SEQ ID NOs: 479, 480, and 481, respectively; $V_{H2}$ comprises a CDR-H1, CDR-H2, and CDR-H3 comprising the sequence of SEQ ID NOs: 485, 486, and 487, respectively; and $V_{H3}$ comprises a CDR-H1, CDR-H2, and CDR-H3 comprising the sequence of SEQ ID NOs: 251, 252, and 253, respectively. In some embodiments, $V_{L1}$ comprises a CDR-L1, CDR-L2, and CDR-L3 comprising the sequence of SEQ ID NOs: 494, 495, and 496, respectively; $V_{L2}$ comprises a CDR-L1, CDR-L2, and CDR-L3 comprising the sequence of SEQ ID NOs: 488, 489, and 490, respectively; $V_{L3}$ comprises a CDR-L1, CDR-L2, and CDR-L3 comprising the sequence of SEQ ID NOs: 269, 270, and 271, respectively; $V_{H1}$ comprises a CDR-H1, CDR-H2, and CDR-H3 comprising the sequence of SEQ ID NOs: 485, 486, and 487, respectively; $V_{H2}$ comprises a CDR-H1, CDR-H2, and CDR-H3 comprising the sequence of SEQ ID NOs: 479, 480, and 481, respectively; and $V_{H3}$ comprises a CDR-H1, CDR-H2, and CDR-H3 comprising the sequence of SEQ ID NOs: 251, 252, and 253, respectively.

In some embodiments, $V_{L1}$ and $V_{H1}$ are light and heavy chain variable domains comprising a light and heavy chain variable sequence of antibody CD28 or CD28_2 described herein, $V_{L2}$ and $V_{H2}$ are light and heavy chain variable domains comprising a light and heavy chain variable sequence of antibody CD3 described herein, and $V_{L3}$ and $V_{H3}$ are light and heavy chain variable domains comprising a light and heavy chain variable sequence of antibody CD4BS "a", CD4BS "b", MPER, MPER_100W, V1/V2 directed "a", V1/V2 directed "b", or V3 directed described herein. In some embodiments, $V_{L1}$ and $V_{H1}$ are light and heavy chain variable domains comprising the six CDRs of antibody CD28 or CD28_2 described herein, $V_{L2}$ and $V_{H2}$ are light and heavy chain variable domains comprising the six CDRs of antibody CD3 described herein, and $V_{L3}$ and $V_{H3}$ are light and heavy chain variable domains comprising the six CDRs of antibody CD4BS "a", CD4BS "b", MPER, MPER 100W, V1/V2 directed "a", V1/V2 directed "b", or V3 directed described herein.

In some embodiments, $V_{L1}$ and $V_{H1}$ are light and heavy chain variable domains comprising a light and heavy chain variable sequence of antibody CD28 or CD28_2 described herein, $V_{L2}$ and $V_{H2}$ are light and heavy chain variable domains comprising a light and heavy chain variable sequence of antibody CD4BS "a", CD4BS "b", MPER, MPER 100W, V1/V2 directed "a", V1/V2 directed "b", or V3 directed described herein, and $V_{L3}$ and $V_{H3}$ are light and heavy chain variable domains comprising a light and heavy chain variable sequence of antibody CD3 described herein. In some embodiments, $V_{L1}$ and $V_{H1}$ are light and heavy chain variable domains comprising the six CDRs of antibody CD28 or CD28_2 described herein, $V_{L2}$ and $V_{H2}$ are light and heavy chain variable domains comprising the six CDRs of antibody CD4BS "a", CD4BS "b", MPER, MPER_100W, V1/V2 directed "a", V1/V2 directed "b", or V3 directed described herein, and $V_{L3}$ and $V_{H3}$ are light and heavy chain variable domains comprising the six CDRs of antibody CD3 described herein.

In some embodiments, $V_{L1}$ and $V_{H1}$ are light and heavy chain variable domains comprising a light and heavy chain variable sequence of antibody CD3 described herein, $V_{L2}$ and $V_{H2}$ are light and heavy chain variable domains comprising a light and heavy chain variable sequence of antibody CD28 or CD28_2 described herein, and $V_{L3}$ and $V_{H3}$ are light and heavy chain variable domains comprising a light and heavy chain variable sequence of antibody CD4BS "a", CD4BS "b", MPER, MPER_100W, V1/V2 directed "a", V1/V2 directed "b", or V3 directed described herein. In some embodiments, $V_{L1}$ and $V_{H1}$ are light and heavy chain variable domains comprising the six CDRs of antibody CD3 described herein, $V_{L2}$ and $V_{H2}$ are light and heavy chain variable domains comprising a light and heavy chain variable sequence of antibody CD28 or CD28_2 described herein, $V_{L2}$ and $V_{H2}$ are light and heavy chain variable domains comprising a light and heavy chain variable sequence of antibody CD4BS "a", CD4BS "b", MPER, MPER_100W, V1/V2 directed "a", V1/V2 directed "b", or V3 directed described herein, and $V_{L3}$ and $V_{H3}$ are light and heavy chain variable domains comprising a light and heavy chain variable sequence of antibody CD28 or CD28_2 described herein. In some embodiments, $V_{L1}$ and $V_{H1}$ are light and heavy chain variable domains comprising the six CDRs of antibody CD3 described herein, $V_{L2}$ and $V_{H2}$ are light and heavy chain variable domains comprising the six CDRs of antibody CD4BS "a", CD4BS "b", MPER, MPER_100W, V1/V2 directed "a", V1/V2 directed "b", or V3 directed described herein, and $V_{L3}$ and $V_{H3}$ are light and heavy chain variable domains comprising the six CDRs of antibody CD28 or CD28_2 described herein.

In some embodiments, $V_{L1}$ and $V_{H1}$ are light and heavy chain variable domains comprising a light and heavy chain variable sequence of antibody CD4BS "a", CD4BS "b", MPER, MPER_100W, V1/V2 directed "a", V1/V2 directed "b", or V3 directed described herein, $V_{L2}$ and $V_{H2}$ are light and heavy chain variable domains comprising a light and heavy chain variable sequence of antibody CD28 or CD28_2 described herein, and $V_{L3}$ and $V_{H3}$ are light and heavy chain variable domains comprising a light and heavy chain variable sequence of antibody CD3 described herein. In some embodiments, $V_{L1}$ and $V_{H1}$ are light and heavy chain variable domains comprising the six CDRs of antibody CD4BS "a", CD4BS "b", MPER, MPER_100W, V1/V2 directed "a", V1/V2 directed "b", or V3 directed described herein, $V_{L2}$ and $V_{H2}$ are light and heavy chain variable domains comprising the six CDRs of antibody CD28 or CD28_2 described herein, and $V_{L3}$ and $V_{H3}$ are light and heavy chain variable domains comprising the six CDRs of antibody CD3 described herein.

In some embodiments, $V_{L1}$ and $V_{H1}$ are light and heavy chain variable domains comprising a light and heavy chain variable sequence of antibody CD4BS "a", CD4BS "b", MPER, MPER_100W, V1/V2 directed "a", V1/V2 directed "b", or V3 directed described herein, $V_{L2}$ and $V_{H2}$ are light and heavy chain variable domains comprising a light and heavy chain variable sequence of antibody CD3 described herein, and $V_{L3}$ and $V_{H3}$ are light and heavy chain variable domains comprising a light and heavy chain variable sequence of antibody CD28 or CD28_2 described herein. In some embodiments, $V_{L1}$ and $V_{H1}$ are light and heavy chain variable domains comprising the six CDRs of antibody CD4BS "a", CD4BS "b", MPER, MPER_100W, V1/V2 directed "a", V1/V2 directed "b", or V3 directed described herein, $V_{L2}$ and $V_{H2}$ are light and heavy chain variable domains comprising the six CDRs of antibody CD3 or CD28_2 described herein, and $V_{L3}$ and $V_{H3}$ are light and heavy chain variable domains comprising the six CDRs of antibody CD28 or CD28_2 described herein.

Target Proteins

In one embodiment, the binding proteins specifically bind to one or more HIV target proteins. In some embodiments, the binding proteins are trispecific and specifically bind to MPER of the HIV-1 gp41 protein, a CD4 binding site of the HIV-1 gp120 protein, a glycan in the V3 loop of the HIV-1 gp120 protein, a trimer apex of the HIV-1 gp120 protein or gp160. In other embodiments, the binding proteins specifically bind to one or more HIV target proteins and one or more target proteins on a T-cell including T cell receptor complex. These T-cell engager binding proteins are capable of recruiting T cells transiently to target cells and, at the same time, activating the cytolytic activity of the T cells. The T-cell engager trispecific antibodies can be used to activate HIV-1 reservoirs and redirect/activate T cells to lyse latently infected HIV-1+ T cells. Examples of target proteins on T cells include but are not limited to CD3 and CD28, among others. In some embodiments, the trispecific binding proteins may be generated by combining the antigen binding domains of two or more monospecific antibodies (parent antibodies) into one antibody. See International Publication Nos. WO 2011/038290 A2, WO 2013/086533 A1, WO 2013/070776 A1, WO 2012/154312 A1, and WO 2013/163427 A1, which are hereby incorporated into this disclosure by reference. The binding proteins of the disclosure may be prepared using domains or sequences obtained or derived from any human or non-human antibody, including, for example, human, murine, or humanized antibodies.

In some embodiments of the disclosure, the trivalent binding protein is capable of binding three different antigen targets. In one embodiment, the binding protein is trispecific and one light chain-heavy chain pair is capable of binding two different antigen targets or epitopes and one light chain-heavy chain pair is capable of binding one antigen target or epitope. In another embodiment, the binding protein is capable of binding three different HIV antigen targets that are located on the HIV envelope glycoprotein structure composed of gp120 and gp41 subunits. In other embodiments, the binding protein is capable of inhibiting the function of one or more of the antigen targets.

In some embodiments, a binding protein of the present disclosure binds one or more HIV target proteins. In some embodiments, the binding protein is capable of specifically binding three different epitopes on a single HIV target protein. In some embodiments, the binding protein is capable of binding two different epitopes on a first HIV target protein, and one epitope on a second HIV target protein. In some embodiments, the first and second HIV target proteins are different. In some embodiments, the binding protein is capable of specifically binding three different HIV target protein. In some embodiments, the one or more HIV target proteins are one or more of glycoprotein 120, glycoprotein 41, and glycoprotein 160.

In some embodiments, a binding protein of the present disclosure binds one or more HIV target proteins and one or more T cell target proteins. In some embodiments, the binding protein is capable of specifically binding one HIV target protein and two different epitopes on a single T cell target protein. In some embodiments, the binding protein is capable of specifically binding one HIV target protein and two different T cell target proteins (e.g., CD28 and CD3). In some embodiments, the binding protein is capable of specifically binding one T cell target protein and two different epitopes on a single HIV target protein. In some embodiments, the binding protein is capable of specifically binding one T cell target protein and two different HIV target proteins. In some embodiments, the first and second polypeptide chains of the binding protein form two antigen binding sites that specifically target two T cell target proteins, and the third and fourth polypeptide chains of the binding protein form an antigen binding site that specifically binds an HIV target protein. In some embodiments, the one or more HIV target proteins are one or more of glycoprotein 120, glycoprotein 41, and glycoprotein 160. In some embodiments, the one or more T cell target proteins are one or more of CD3 and CD28.

Linkers

In some embodiments, the linkers $L_1$, $L_2$, $L_3$, and $L_4$ range from no amino acids (length=0) to about 100 amino acids long, or less than 100, 50, 40, 30, 20, or 15 amino acids or less. The linkers can also be 10, 9, 8, 7, 6, 5, 4, 3, 2, or 1 amino acids long. $L_1$, $L_2$, $L_3$, and $L_4$ in one binding protein may all have the same amino acid sequence or may all have different amino acid sequences.

Examples of suitable linkers include a single glycine (Gly) residue; a diglycine peptide (Gly-Gly); a tripeptide (Gly-Gly-Gly); a peptide with four glycine residues (Gly-Gly-Gly-Gly; SEQ ID NO: 285); a peptide with five glycine residues (Gly-Gly-Gly-Gly-Gly; SEQ ID NO: 286); a peptide with six glycine residues (Gly-Gly-Gly-Gly-Gly-Gly; SEQ ID NO: 287); a peptide with seven glycine residues (Gly-Gly-Gly-Gly-Gly-Gly-Gly; SEQ ID NO: 288); a peptide with eight glycine residues (Gly-Gly-Gly-Gly-Gly-Gly-Gly-Gly; SEQ ID NO: 289). Other combinations of amino acid residues may be used such as the peptide Gly-Gly-Gly-Gly-Ser (SEQ ID NO: 290), the peptide Gly-Gly-Gly-Gly-Ser-Gly-Gly-Gly-Gly-Ser (SEQ ID NO: 291) and the peptide Gly-Gly-Gly-Gly-Ser-Gly-Gly-Gly-Ser-Gly-Gly-Gly-Gly-Ser (SEQ ID NO: 292). Other suitable linkers include a single Ser, and Val residue; the dipeptide Arg-Thr, Gln-Pro, Ser-Ser, Thr-Lys, and Ser-Leu; Thr-Lys-Gly-Pro-Ser (SEQ ID NO: 293), Thr-Val-Ala-Ala-Pro (SEQ ID NO: 294), Gln-Pro-Lys-Ala-Ala (SEQ ID NO: 295), Gln-Arg-Ile-Glu-Gly (SEQ ID NO: 296); Ala-Ser-Thr-Lys-Gly-Pro-Ser (SEQ ID NO: 297), Arg-Thr-Val-Ala-Ala-Pro-Ser (SEQ ID NO: 298), Gly-Gln-Pro-Lys-Ala-Ala-Pro (SEQ ID NO: 299), and His-Ile-Asp-Ser-Pro-Asn-Lys (SEQ ID NO: 300). The examples listed above are not intended to limit the scope of the disclosure in any way, and linkers comprising randomly selected amino acids selected from the group consisting of valine, leucine, isoleucine, serine, threonine, lysine, arginine, histidine, aspartate, glutamate, asparagine, glutamine, glycine, and proline have been shown to be suitable in the binding proteins.

The identity and sequence of amino acid residues in the linker may vary depending on the type of secondary structural element necessary to achieve in the linker. For example, glycine, serine, and alanine are best for linkers having maximum flexibility. Some combination of glycine, proline, threonine, and serine are useful if a more rigid and extended linker is necessary. Any amino acid residue may be considered as a linker in combination with other amino acid residues to construct larger peptide linkers as necessary depending on the desired properties.

In some embodiments, the length of $L_1$ is at least twice the length of $L_3$. In some embodiments, the length of $L_2$ is at least twice the length of $L_4$. In some embodiments, the length of $L_1$ is at least twice the length of $L_3$, and the length of $L_2$ is at least twice the length of $L_4$. In some embodiments, $L_1$ is 3 to 12 amino acid residues in length, $L_2$ is 3 to 14 amino acid residues in length, $L_3$ is 1 to 8 amino acid residues in length, and $L_4$ is 1 to 3 amino acid residues in length. In some embodiments, $L_1$ is 5 to 10 amino acid residues in length, $L_2$ is 5 to 8 amino acid residues in length, $L_3$ is 1 to 5 amino acid residues in length, and $L_4$ is 1 to 2 amino acid residues in length. In some embodiments, $L_1$ is 7 amino acid residues in length, $L_2$ is 5 amino acid residues in length, $L_3$ is 1 amino acid residue in length, and $L_4$ is 2 amino acid residues in length.

In some embodiments, $L_1$, $L_2$, $L_3$, and/or $L_4$ comprise the sequence Asp-Lys-Thr-His-Thr (SEQ ID NO: 525). In some embodiments, $L_1$ comprises the sequence Asp-Lys-Thr-His-Thr (SEQ ID NO: 525). In some embodiments, $L_3$ comprises the sequence Asp-Lys-Thr-His-Thr (SEQ ID NO: 525).

In some embodiments, $L_1$, $L_2$, $L_3$, and/or $L_4$ comprise the sequence Gly-Gln-Pro-Lys-Ala-Ala-Pro (SEQ ID NO: 299). In some embodiments, $L_1$ comprises the sequence Gly-Gln-Pro-Lys-Ala-Ala-Pro (SEQ ID NO: 299). In some embodiments, $L_1$ comprises the sequence Gly-Gln-Pro-Lys-Ala- Ala-Pro (SEQ ID NO: 299), $L_2$ comprises the sequence Thr-Lys-Gly-Pro-Ser-Arg (SEQ ID NO: 526), $L_3$ comprises the sequence Ser, and $L_4$ comprises the sequence Arg-Thr. In some embodiments, $L_3$ comprises the sequence Gly-Gln-Pro-Lys-Ala-Ala-Pro (SEQ ID NO: 299). In some embodiments, $L_1$ comprises the sequence Ser, $L_2$ comprises the sequence Arg-Thr, $L_3$ comprises the sequence Gly-Gln-Pro-Lys-Ala-Ala-Pro (SEQ ID NO: 299) and $L_4$ comprises the sequence Thr-Lys-Gly-Pro-Ser-Arg (SEQ ID NO: 526).

Fc Regions and Constant Domains

In some embodiments, a binding protein of the present disclosure comprises a second polypeptide chain further comprising an Fc region linked to $C_{H1}$, the Fc region comprising an immunoglobulin hinge region and $C_{H2}$ and $C_{H3}$ immunoglobulin heavy chain constant domains. In some embodiments, a binding protein of the present disclosure comprises a third polypeptide chain further comprising an Fc region linked to $C_{H1}$, the Fc region comprising an immunoglobulin hinge region and $C_{H2}$ and $C_{H3}$ immunoglobulin heavy chain constant domains. In some embodiments, a binding protein of the present disclosure comprises a second polypeptide chain further comprising an Fc region linked to $C_{H1}$, the Fc region comprising an immunoglobulin hinge region and $C_{H2}$ and $C_{H3}$ immunoglobulin heavy chain constant domains, and a third polypeptide chain further comprising an Fc region linked to $C_{H1}$, the Fc region comprising an immunoglobulin hinge region and $C_{H2}$ and $C_{H3}$ immunoglobulin heavy chain constant domains.

To improve the yields of the binding proteins, in some embodiments, the $C_{H3}$ domains can be altered by the "knob-into-holes" technology which is described in detail with several examples in, for example, International Publication No. WO 96/027011, Ridgway et al., 1996, *Protein Eng.* 9: 617-21; and Merchant et al., 1998, *Nat. Biotechnol.* 16: 677-81. Specifically, the interaction surfaces of the two $C_{H3}$ domains are altered to increase the heterodimerisation of both heavy chains containing these two $C_{H3}$ domains. Each of the two $C_{H3}$ domains (of the two heavy chains) can be the "knob," while the other is the "hole." The introduction of a disulfide bridge further stabilizes the heterodimers (Merchant et al., 1998; Atwell et al., 1997, *J. Mol. Biol.* 270: 26-35) and increases the yield. In particular embodiments, the knob is on the second pair of polypeptides with a single variable domain. In other embodiments, the knob is on the first pair of polypeptides having the cross-over orientation. In yet other embodiments, the $C_{H3}$ domains do not include a knob in hole.

In some embodiments, a binding protein of the present disclosure comprises a "knob" mutation on the second polypeptide chain and a "hole" mutation on the third polypeptide chain. In some embodiments, a binding protein of the present disclosure comprises a "knob" mutation on the third polypeptide chain and a "hole" mutation on the second polypeptide chain. In some embodiments, the "knob" mutation comprises substitutions at positions corresponding to positions 354 and 366 of human IgG1 according to EU Index. In some embodiments, the amino acid substitutions are S354C and T366W. In some embodiments, the "hole" mutation comprises substitutions at positions corresponding to positions 349, 366, 368, and 407 of human IgG1 according to EU Index. In some embodiments, the amino acid substitutions are Y349C, T366S, L368A, and Y407V. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 354 and 366 of human IgG1 according to EU Index, wherein the amino acid substitutions are S354C and T366W; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 349, 366, 368, and 407 of human IgG1 according to EU Index, wherein the amino acid substitutions are Y349C, T366S, L368A, and Y407V. In some embodiments, the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 349, 366, 368, and 407 of human IgG1 according to EU Index, wherein the amino acid substitutions are Y349C, T366S, L368A, and Y407V; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 354 and 366 of human IgG1 according to EU Index, wherein the amino acid substitutions are S354C and T366W.

In some embodiments, a binding protein of the present disclosure comprises one or more mutations to improve serum half-life (See e.g., Hinton, P. R. et al. (2006) *J. Immunol.* 176(1):346-56). In some embodiments, the mutation comprises substitutions at positions corresponding to positions 428 and 434 of human IgG1 according to EU Index, wherein the amino acid substitutions are M428L and N434S. In some embodiments, the binding protein comprises a second polypeptide chain further comprising a first Fc region linked to $C_{H1}$, the first Fc region comprising an immunoglobulin hinge region and $C_{H2}$ and $C_{H3}$ immunoglobulin heavy chain constant domains, and a third polypeptide chain further comprising a second Fc region linked to $C_{H1}$, the second Fc region comprising an immunoglobulin hinge region and $C_{H2}$ and $C_{H3}$ immunoglobulin heavy chain constant domains, wherein the first and second Fc regions comprise amino acid substitutions at positions corresponding to positions 428 and 434 of human IgG1 according to EU Index, wherein the amino acid substitutions are M428L and N434S. In some embodiments, a binding protein of the present disclosure comprises knob and hole mutations and one or more mutations to improve serum half-life.

In some embodiments, $C_{H1}$, $C_{H2}$, $C_{H3}$ and $C_L$ of the trispecific binding proteins described herein may comprise any of $C_{H1}$, $C_{H2}$, $C_{H3}$ and $C_L$ sequences of binding proteins 1-53.

Nucleic Acids

Standard recombinant DNA methodologies are used to construct the polynucleotides that encode the polypeptides which form the binding proteins, incorporate these polynucleotides into recombinant expression vectors, and introduce such vectors into host cells. See e.g., Sambrook et al., 2001, MOLECULAR CLONING: A LABORATORY MANUAL (Cold Spring Harbor Laboratory Press, 3rd ed.). Enzymatic reactions and purification techniques may be performed according to manufacturer's specifications, as commonly accomplished in the art, or as described herein. Unless specific definitions are provided, the nomenclature utilized in connection with, and the laboratory procedures and techniques of, analytical chemistry, synthetic organic chemistry, and medicinal and pharmaceutical chemistry described herein are those well-known and commonly used in the art. Similarly, conventional techniques may be used for chemical syntheses, chemical analyses, pharmaceutical preparation, formulation, delivery, and treatment of patients.

Other aspects of the present disclosure relate to isolated nucleic acid molecules comprising a nucleotide sequence encoding any of the binding proteins described herein. In some embodiments, the isolated nucleic acid is operably linked to a heterologous promoter to direct transcription of the binding protein-coding nucleic acid sequence. A promoter may refer to nucleic acid control sequences which direct transcription of a nucleic acid. A first nucleic acid sequence is operably linked to a second nucleic acid sequence when the first nucleic acid sequence is placed in a functional relationship with the second nucleic acid sequence. For instance, a promoter is operably linked to a coding sequence of a binding protein if the promoter affects the transcription or expression of the coding sequence. Examples of promoters may include, but are not limited to, promoters obtained from the genomes of viruses (such as polyoma virus, fowlpox virus, adenovirus (such as Adenovirus 2), bovine papilloma virus, avian sarcoma virus, cytomegalovirus, a retrovirus, hepatitis-B virus, Simian Virus 40 (SV40), and the like), from heterologous eukaryotic promoters (such as the actin promoter, an immunoglobulin promoter, from heat-shock promoters, and the like), the CAG-promoter (Niwa et al., Gene 108(2): 193-9, 1991), the phosphoglycerate kinase (PGK)-promoter, a tetracycline-inducible promoter (Masui et al., Nucleic Acids Res. 33:e43, 2005), the lac system, the trp system, the tac system, the trc system, major operator and promoter regions of phage lambda, the promoter for 3-phosphoglycerate kinase, the promoters of yeast acid phosphatase, and the promoter of the yeast alpha-mating factors. Polynucleotides encoding binding proteins of the present disclosure may be under the control of a constitutive promoter, an inducible promoter, or any other suitable promoter described herein or other suitable promoter that will be readily recognized by one skilled in the art.

In some embodiments, the isolated nucleic acid is incorporated into a vector. In some embodiments, the vector is an expression vector. Expression vectors may include one or more regulatory sequences operatively linked to the polynucleotide to be expressed. The term "regulatory sequence" includes promoters, enhancers and other expression control elements (e.g., polyadenylation signals). Examples of suitable enhancers may include, but are not limited to, enhancer sequences from mammalian genes (such as globin, elastase, albumin, α-fetoprotein, insulin and the like), and enhancer sequences from a eukaryotic cell virus (such as SV40 enhancer on the late side of the replication origin (bp 100-270), the cytomegalovirus early promoter enhancer, the polyoma enhancer on the late side of the replication origin, adenovirus enhancers, and the like). Examples of suitable vectors may include, for example, plasmids, cosmids, episomes, transposons, and viral vectors (e.g., adenoviral, vaccinia viral, Sindbis-viral, measles, herpes viral, lentiviral, retroviral, adeno-associated viral vectors, etc.). Expression vectors can be used to transfect host cells, such as, for example, bacterial cells, yeast cells, insect cells, and mammalian cells. Biologically functional viral and plasmid DNA vectors capable of expression and replication in a host are known in the art, and can be used to transfect any cell of interest.

Other aspects of the present disclosure relate to a vector system comprising one or more vectors encoding a first, second, third, and fourth polypeptide chain of any of the binding proteins described herein. In some embodiments, the vector system comprises a first vector encoding the first polypeptide chain of the binding protein, a second vector encoding the second polypeptide chain of the binding protein, a third vector encoding the third polypeptide chain of the binding protein, and a fourth vector encoding the fourth polypeptide chain of the binding protein. In some embodiments, the vector system comprises a first vector encoding the first and second polypeptide chains of the binding protein, and a second vector encoding the third and fourth polypeptide chains of the binding protein. In some embodiments, the vector system comprises a first vector encoding the first and third polypeptide chains of the binding protein, and a second vector encoding the second and fourth polypeptide chains of the binding protein. In some embodiments, the vector system comprises a first vector encoding the first and fourth polypeptide chains of the binding protein, and a second vector encoding the second and third polypeptide chains of the binding protein. In some embodiments, the vector system comprises a first vector encoding the first, second, third, and fourth polypeptide chains of the binding protein. The one or more vectors of the vector system may be any of the vectors described herein. In some embodiments, the one or more vectors are expression vectors.

Host Cells

Other aspects of the present disclosure relate to a host cell (e.g., an isolated host cell) comprising one or more isolated polynucleotides, vectors, and/or vector systems described herein. In some embodiments, an isolated host cell of the present disclosure is cultured in vitro. In some embodiments, the host cell is a bacterial cell (e.g., an *E. coli* cell). In some embodiments, the host cell is a yeast cell (e.g., an *S. cerevisiae* cell). In some embodiments, the host cell is an insect cell. Examples of insect host cells may include, for example, *Drosophila* cells (e.g., S2 cells), *Trichoplusia ni* cells (e.g., High Five™ cells), and Spodopterafrugiperda cells (e.g., Sf21 or Sf9 cells). In some embodiments, the host cell is a mammalian cell. Examples of mammalian host cells may include, for example, human embryonic kidney cells (e.g., 293 or 293 cells subcloned for growth in suspension culture), Expi293™ cells, CHO cells, baby hamster kidney cells (e.g., BHK, ATCC CCL 10), mouse sertoli cells (e.g., TM4 cells), monkey kidney cells (e.g., CV1 ATCC CCL 70), African green monkey kidney cells (e.g., VERO-76, ATCC CRL-1587), human cervical carcinoma cells (e.g., HELA, ATCC CCL 2), canine kidney cells (e.g., MDCK, ATCC CCL 34), buffalo rat liver cells (e.g., BRL 3A, ATCC CRL 1442), human lung cells (e.g., W138, ATCC CCL 75), human liver cells (e.g., Hep G2, HB 8065), mouse mammary tumor cells (e.g., MMT 060562, ATCC CCL51), TRI cells, MRC 5 cells, FS4 cells, a human hepatoma line (e.g., Hep G2), and myeloma cells (e.g., NSO and Sp2/0 cells).

Other aspects of the present disclosure relate to a method of producing any of the binding proteins described herein. In some embodiments, the method includes a) culturing a host cell (e.g., any of the host cells described herein) comprising an isolated nucleic acid, vector, and/or vector system (e.g., any of the isolated nucleic acids, vectors, and/or vector systems described herein) under conditions such that the host cell expresses the binding protein; and b) isolating the binding protein from the host cell. Methods of culturing host cells under conditions to express a protein are well known to one of ordinary skill in the art. Methods of isolating proteins from cultured host cells are well known to one of ordinary skill in the art, including, for example, by affinity chromatography (e.g., two step affinity chromatography comprising protein A affinity chromatography followed by size exclusion chromatography).

Use for Binding Proteins

The binding proteins can be employed in any known assay method, such as competitive binding assays, direct and indirect sandwich assays, and immunoprecipitation assays for the detection and quantitation of one or more target antigens. The binding proteins will bind the one or more target antigens with an affinity that is appropriate for the assay method being employed.

For diagnostic applications, in certain embodiments, binding proteins can be labeled with a detectable moiety. The detectable moiety can be any one that is capable of producing, either directly or indirectly, a detectable signal. For example, the detectable moiety can be a radioisotope, such as $^3H$, $^{14}C$, $^{32}P$, $^{35}S$, $^{125}I$, $^{99}Tc$, $^{111}In$, or $^{67}Ga$; a fluorescent or chemiluminescent compound, such as fluorescein isothiocyanate, rhodamine, or luciferin; or an enzyme, such as alkaline phosphatase, β-galactosidase, or horseradish peroxidase.

The binding proteins are also useful for in vivo imaging. A binding protein labeled with a detectable moiety can be administered to an animal, e.g., into the bloodstream, and the presence and location of the labeled antibody in the host assayed. The binding protein can be labeled with any moiety that is detectable in an animal, whether by nuclear magnetic resonance, radiology, or other detection means known in the art.

The disclosure also relates to a kit comprising a binding protein and other reagents useful for detecting target antigen levels in biological samples. Such reagents can include a detectable label, blocking serum, positive and negative control samples, and detection reagents. In some embodiments, the kit comprises a composition comprising any binding protein, polynucleotide, vector, vector system, and/or host cell described herein. In some embodiments, the kit comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing a condition (e.g., HIV infection) and may have a sterile access port (for example the container may be an intravenous solution bag or a vial having a stopper pierceable by a hypodermic injection needle). In some embodiments, the label or package insert indicates that the composition is used for preventing, diagnosing, and/or treating the condition of choice. Alternatively, or additionally, the article of manufacture or kit may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

Therapeutic or pharmaceutical compositions comprising binding proteins are within the scope of the disclosure. Such therapeutic or pharmaceutical compositions can comprise a therapeutically effective amount of a binding protein, or binding protein-drug conjugate, in admixture with a pharmaceutically or physiologically acceptable formulation agent selected for suitability with the mode of administration.

Acceptable formulation materials are nontoxic to recipients at the dosages and concentrations employed.

The pharmaceutical composition can contain formulation materials for modifying, maintaining, or preserving, for example, the pH, osmolarity, viscosity, clarity, color, isotonicity, odor, sterility, stability, rate of dissolution or release, adsorption, or penetration of the composition. Suitable formulation materials include, but are not limited to, amino acids (such as glycine, glutamine, asparagine, arginine, or lysine), antimicrobials, antioxidants (such as ascorbic acid, sodium sulfite, or sodium hydrogen-sulfite), buffers (such as borate, bicarbonate, Tris-HCl, citrates, phosphates, or other organic acids), bulking agents (such as mannitol or glycine), chelating agents (such as ethylenediamine tetraacetic acid (EDTA)), complexing agents (such as caffeine, polyvinylpyrrolidone, beta-cyclodextrin, or hydroxypropyl-beta-cyclodextrin), fillers, monosaccharides, disaccharides, and other carbohydrates (such as glucose, mannose, or dextrins), proteins (such as serum albumin, gelatin, or immunoglobulins), coloring, flavoring and diluting agents, emulsifying agents, hydrophilic polymers (such as polyvinylpyrrolidone), low molecular weight polypeptides, salt-forming counterions (such as sodium), preservatives (such as benzalkonium chloride, benzoic acid, salicylic acid, thimerosal, phenethyl alcohol, methylparaben, propylparaben, chlorhexidine, sorbic acid, or hydrogen peroxide), solvents (such as glycerin, propylene glycol, or polyethylene glycol), sugar alcohols (such as mannitol or sorbitol), suspending agents, surfactants or wetting agents (such as pluronics; PEG; sorbitan esters; polysorbates such as polysorbate 20 or polysorbate 80; triton; tromethamine; lecithin; cholesterol or tyloxapal), stability enhancing agents (such as sucrose or sorbitol), tonicity enhancing agents (such as alkali metal halides—e.g., sodium or potassium chloride—or mannitol sorbitol), delivery vehicles, diluents, excipients and/or pharmaceutical adjuvants (see, e.g., REMINGTON'S PHARMACEUTICAL SCIENCES (18th Ed., A. R. Gennaro, ed., Mack Publishing Company 1990), and subsequent editions of the same, incorporated herein by reference for any purpose).

The optimal pharmaceutical composition will be determined by a skilled artisan depending upon, for example, the intended route of administration, delivery format, and desired dosage. Such compositions can influence the physical state, stability, rate of in vivo release, and rate of in vivo clearance of the binding protein.

The primary vehicle or carrier in a pharmaceutical composition can be either aqueous or non-aqueous in nature. For example, a suitable vehicle or carrier for injection can be water, physiological saline solution, or artificial cerebrospinal fluid, possibly supplemented with other materials common in compositions for parenteral administration. Neutral buffered saline or saline mixed with serum albumin are further exemplary vehicles. Other exemplary pharmaceutical compositions comprise Tris buffer of about pH 7.0-8.5, or acetate buffer of about pH 4.0-5.5, which can further include sorbitol or a suitable substitute. In one embodiment of the disclosure, binding protein compositions can be prepared for storage by mixing the selected composition having the desired degree of purity with optional formulation agents in the form of a lyophilized cake or an aqueous solution. Further, the binding protein can be formulated as a lyophilizate using appropriate excipients such as sucrose.

The pharmaceutical compositions of the disclosure can be selected for parenteral delivery or subcutaneous. Alternatively, the compositions can be selected for inhalation or for delivery through the digestive tract, such as orally. The preparation of such pharmaceutically acceptable compositions is within the skill of the art.

The formulation components are present in concentrations that are acceptable to the site of administration. For example, buffers are used to maintain the composition at physiological pH or at a slightly lower pH, typically within a pH range of from about 5 to about 8.

When parenteral administration is contemplated, the therapeutic compositions for use can be in the form of a pyrogen-free, parenterally acceptable, aqueous solution comprising the desired binding protein in a pharmaceutically acceptable vehicle. A particularly suitable vehicle for parenteral injection is sterile distilled water in which a binding protein is formulated as a sterile, isotonic solution, properly preserved. Yet another preparation can involve the formulation of the desired molecule with an agent, such as injectable microspheres, bio-erodible particles, polymeric compounds (such as polylactic acid or polyglycolic acid), beads, or liposomes, that provides for the controlled or sustained release of the product which can then be delivered via a depot injection. Hyaluronic acid can also be used, and this can have the effect of promoting sustained duration in the circulation. Other suitable means for the introduction of the desired molecule include implantable drug delivery devices.

In one embodiment, a pharmaceutical composition can be formulated for inhalation. For example, a binding protein can be formulated as a dry powder for inhalation. Binding protein inhalation solutions can also be formulated with a propellant for aerosol delivery. In yet another embodiment, solutions can be nebulized.

It is also contemplated that certain formulations can be administered orally. In one embodiment of the disclosure, binding proteins that are administered in this fashion can be formulated with or without those carriers customarily used in the compounding of solid dosage forms such as tablets and capsules. For example, a capsule can be designed to release the active portion of the formulation at the point in the gastrointestinal tract where bioavailability is maximized and pre-systemic degradation is minimized. Additional agents can be included to facilitate absorption of the binding protein. Diluents, flavorings, low melting point waxes, vegetable oils, lubricants, suspending agents, tablet disintegrating agents, and binders can also be employed.

Another pharmaceutical composition can involve an effective quantity of binding proteins in a mixture with non-toxic excipients that are suitable for the manufacture of tablets. By dissolving the tablets in sterile water, or another appropriate vehicle, solutions can be prepared in unit-dose form. Suitable excipients include, but are not limited to, inert diluents, such as calcium carbonate, sodium carbonate or bicarbonate, lactose, or calcium phosphate; or binding agents, such as starch, gelatin, or acacia; or lubricating agents such as magnesium stearate, stearic acid, or talc.

Additional pharmaceutical compositions of the disclosure will be evident to those skilled in the art, including formulations involving binding proteins in sustained- or controlled-delivery formulations. Techniques for formulating a variety of other sustained- or controlled-delivery means, such as liposome carriers, bio-erodible microparticles or porous beads and depot injections, are also known to those skilled in the art. Additional examples of sustained-release preparations include semipermeable polymer matrices in the form of shaped articles, e.g. films, or microcapsules. Sustained release matrices can include polyesters, hydrogels, polylactides, copolymers of L-glutamic acid and gamma ethyl-L-glutamate, poly(2-hydroxyethyl-methacrylate), ethylene vinyl acetate, or poly-D(-)-3-hydroxybutyric acid. Sustained-release compositions can also include liposomes, which can be prepared by any of several methods known in the art.

Pharmaceutical compositions to be used for in vivo administration typically must be sterile. This can be accomplished by filtration through sterile filtration membranes. Where the composition is lyophilized, sterilization using this method can be conducted either prior to, or following, lyophilization and reconstitution. The composition for parenteral administration can be stored in lyophilized form or in a solution. In addition, parenteral compositions generally are placed into a container having a sterile access port, for example, an intravenous solution bag or vial having a stopper pierceable by a hypodermic injection needle.

Once the pharmaceutical composition has been formulated, it can be stored in sterile vials as a solution, suspension, gel, emulsion, solid, or as a dehydrated or lyophilized powder. Such formulations can be stored either in a ready-to-use form or in a form (e.g., lyophilized) requiring reconstitution prior to administration.

The disclosure also encompasses kits for producing a single-dose administration unit. The kits can each contain both a first container having a dried protein and a second container having an aqueous formulation. Also included within the scope of this disclosure are kits containing single and multi-chambered pre-filled syringes (e.g., liquid syringes and lyosyringes).

The effective amount of a binding protein pharmaceutical composition to be employed therapeutically will depend, for example, upon the therapeutic context and objectives. One skilled in the art will appreciate that the appropriate dosage levels for treatment will thus vary depending, in part, upon the molecule delivered, the indication for which the binding protein is being used, the route of administration, and the size (body weight, body surface, or organ size) and condition (the age and general health) of the patient. Accordingly, the clinician can titer the dosage and modify the route of administration to obtain the optimal therapeutic effect.

Dosing frequency will depend upon the pharmacokinetic parameters of the binding protein in the formulation being used. Typically, a clinician will administer the composition until a dosage is reached that achieves the desired effect. The composition can therefore be administered as a single dose, as two or more doses (which may or may not contain the same amount of the desired molecule) over time, or as a continuous infusion via an implantation device or catheter. Further refinement of the appropriate dosage is routinely made by those of ordinary skill in the art and is within the ambit of tasks routinely performed by them. Appropriate dosages can be ascertained through use of appropriate dose-response data.

The route of administration of the pharmaceutical composition is in accord with known methods, e.g., orally; through injection by intravenous, intraperitoneal, intracerebral (intraparenchymal), intracerebroventricular, intramuscular, intraocular, intraarterial, intraportal, or intralesional routes; by sustained release systems; or by implantation devices. Where desired, the compositions can be administered by bolus injection or continuously by infusion, or by implantation device.

The composition can also be administered locally via implantation of a membrane, sponge, or other appropriate material onto which the desired molecule has been absorbed or encapsulated. Where an implantation device is used, the device can be implanted into any suitable tissue or organ, and delivery of the desired molecule can be via diffusion, timed-release bolus, or continuous administration.

The pharmaceutical compositions can be used to prevent and/or treat HIV infection. The pharmaceutical compositions can be used as a standalone therapy or in combination with standard anti-retroviral therapy.

In some embodiments, the present disclosure relates to a method of preventing and/or treating HIV infection in a patient. In some embodiments, the method comprises administering to the patient a therapeutically effective amount of at least one of the binding proteins described herein. In some embodiments, the at least one binding protein is administered in combination with an anti-retroviral therapy (e.g., an anti-HIV therapy). In some embodiments, the at least one binding protein is administered before the anti-retroviral therapy. In some embodiments, the at least one binding protein is administered concurrently with the anti-retroviral therapy. In some embodiments, the at least one binding protein is administered after the anti-retroviral therapy. In some embodiments, the at least one binding protein is co-administered with any standard anti-retroviral therapy known in the art. In some embodiments, administration of the at least one binding protein results in neutralization of one or more HIV virions. In some embodiments, administration of the at least one binding protein results in elimination of one or more latently and/or chronically HIV-infected cells in the patient. In some embodiments, administration of the at least one binding protein results in neutralization of one or more HIV virions and results in elimination of one or more latently and/or chronically HIV-infected cells in the patient. In some embodiments, the patient is a human.

Without limiting the present disclosure, a number of embodiments of the present disclosure are described below for purpose of illustration.

Item 1: A binding protein comprising four polypeptide chains that form three antigen binding sites that specifically bind one or more HIV target proteins, wherein a first polypeptide chain comprises a structure represented by the formula:

$$V_{L2}\text{-}L_1\text{-}V_{L1}\text{-}L_2\text{-}C_L \qquad [I]$$

and a second polypeptide chain comprises a structure represented by the formula:

$$V_{H1}\text{-}L_3\text{-}V_{H2}\text{-}L_4\text{-}C_{H1} \qquad [II]$$

and a third polypeptide chain comprises a structure represented by the formula:

$$V_{H3}\text{-}C_{H1} \qquad [III]$$

and a fourth polypeptide chain comprises a structure represented by the formula:

$$V_{L3}\text{-}C_L \qquad [IV]$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$, and $L_4$ are amino acid linkers;
and wherein the polypeptide of formula I and the polypeptide of formula II form a cross-over light chain-heavy chain pair.

Item 2: A binding protein comprising four polypeptide chains that form three antigen binding sites that specifically bind one or more HIV target proteins, wherein a first polypeptide chain comprises a structure represented by the formula:

$$V_{L2}\text{-}L_1\text{-}V_{L1}\text{-}L_2\text{-}C_L \qquad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \qquad [II]$$

and a third polypeptide chain comprises a structure represented by the formula:

$$V_{H3}\text{-}C_{H1}\text{-hinge-}C_{H2}\text{-}C_{H3} \qquad [III]$$

and a fourth polypeptide chain comprises a structure represented by the formula:

$$V_{L3}\text{-}C_L \qquad [IV]$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is an immunoglobulin $C_{H1}$ heavy chain constant domain;
$C_{H2}$ is an immunoglobulin $C_{H2}$ heavy chain constant domain;
$C_{H3}$ is an immunoglobulin $C_{H3}$ heavy chain constant domain;
hinge is an immunoglobulin hinge region connecting the $C_{H1}$ and $C_{H2}$ domains; and
$L_1$, $L_2$, $L_3$ and $L_4$ are amino acid linkers;
and wherein the polypeptide of formula I and the polypeptide of formula II form a cross-over light chain-heavy chain pair.

Item 3: The binding protein of item 1 or item 2, wherein the one or more HIV target proteins is selected from the group consisting of glycoprotein 120, glycoprotein 41 and glycoprotein 60.

Item 4: The binding protein of item 1 or item 2, wherein the binding protein is trispecific and capable of specifically binding three different epitopes on a single HIV target protein.

Item 5: The binding protein of item 1 or item 2, wherein the binding protein is trispecific and capable of specifically binding two different epitopes on a first HIV target protein, and one epitope on a second HIV target protein, wherein the first and second HIV target proteins are different.

Item 6: The binding protein of item 1 or item 2, wherein the binding protein is trispecific and capable of specifically binding three different antigen targets.

Item 7: The binding protein of item 1 or item 2, wherein the binding protein is capable of inhibiting the function of one or more HIV target proteins.

Item 8: The binding protein of any one of items 1-7, wherein $V_{L1}$ comprises a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; or a sequence as set forth in SEQ ID NOs: 278, 279, and 280, respectively.

Item 9: The binding protein of any one of items 1-7, wherein $V_{L1}$ comprises a CDR-L1, CDR-L2, and CDR-L3 of a light chain variable domain comprising a sequence selected from the group consisting of SEQ ID NOs: 512, 513, 514, 515, 516, 517, 518, 519, 520, and 521.

Item 10: The binding protein of any one of items 1-9, wherein $V_{L1}$ comprises a light chain variable domain comprising a sequence selected from the group consisting of SEQ ID NOs: 512, 513, 514, 515, 516, 517, 518, 519, 520, and 521.

Item 11: The binding protein of any one of items 1-10, wherein $V_{L2}$ comprises a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; or a sequence as set forth in SEQ ID NOs: 278, 279, and 280, respectively.

Item 12: The binding protein of any one of items 1-10, wherein $V_{L2}$ comprises a CDR-L1, CDR-L2, and CDR-L3 of a light chain variable domain comprising a sequence selected from the group consisting of SEQ ID NOs: 512, 513, 514, 515, 516, 517, 518, 519, 520, and 521.

Item 13: The binding protein of any one of items 1-12, wherein $V_{L2}$ comprises a light chain variable domain comprising a sequence selected from the group consisting of SEQ ID NOs: 512, 513, 514, 515, 516, 517, 518, 519, 520, and 521.

Item 14: The binding protein of any one of items 1-13, wherein $V_{L3}$ comprises a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; or a sequence as set forth in SEQ ID NOs: 278, 279, and 280, respectively.

Item 15: The binding protein of any one of items 1-13, wherein $V_{L3}$ comprises a CDR-L1, CDR-L2, and CDR-L3 of a light chain variable domain comprising a sequence selected from the group consisting of SEQ ID NOs: 512, 513, 514, 515, 516, 517, 518, 519, 520, and 521.

Item 16: The binding protein of any one of items 1-15, wherein $V_{L3}$ comprises a light chain variable domain comprising a sequence selected from the group consisting of SEQ ID NOs: 512, 513, 514, 515, 516, 517, 518, 519, 520, and 521.

Item 17: The binding protein of any one of items 1-16, wherein $V_{H1}$ comprises a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; or a sequence as set forth in SEQ ID NOs: 499, 261, and 262, respectively.

Item 18: The binding protein of any one of items 1-16, wherein $V_{H1}$ comprises a CDR-H1, CDR-H2, and CDR-H3 of a heavy chain variable domain comprising a sequence selected from the group consisting of SEQ ID NOs: 502, 503, 504, 505, 506, 507, and 508.

Item 19: The binding protein of any one of items 1-18, wherein $V_{H1}$ comprises a heavy chain variable domain comprising a sequence selected from the group consisting of SEQ ID NOs: 502, 503, 504, 505, 506, 507, and 508.

Item 20: The binding protein of any one of items 1-19, wherein $V_{H2}$ comprises a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; or a sequence as set forth in SEQ ID NOs: 499, 261, and 262, respectively.

Item 21: The binding protein of any one of items 1-19, wherein $V_{H2}$ comprises a CDR-H1, CDR-H2, and CDR-H3 of a heavy chain variable domain comprising a sequence selected from the group consisting of SEQ ID NOs: 502, 503, 504, 505, 506, 507, and 508.

Item 22: The binding protein of any one of items 1-21, wherein $V_{H2}$ comprises a heavy chain variable domain comprising a sequence selected from the group consisting of SEQ ID NOs: 502, 503, 504, 505, 506, 507, and 508.

Item 23: The binding protein of any one of items 1-22, wherein $V_{H3}$ comprises a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; or a sequence as set forth in SEQ ID NOs: 499, 261, and 262, respectively.

Item 24: The binding protein of any one of items 1-22, wherein $V_{H3}$ comprises a CDR-H1, CDR-H2, and CDR-H3 of a heavy chain variable domain comprising a sequence selected from the group consisting of SEQ ID NOs: 502, 503, 504, 505, 506, 507, and 508.

Item 25: The binding protein of any one of items 1-24, wherein $V_{H3}$ comprises a heavy chain variable domain comprising a sequence selected from the group consisting of SEQ ID NOs: 502, 503, 504, 505, 506, 507, and 508.

Item 26: The binding protein of any one of items 1-25, wherein $V_{L1}$ comprises a CDR-L1 comprising the sequence of SEQ ID NO: 500, a CDR-L2 comprising the sequence of SEQ ID NO: 501, and a CDR-L3 comprising the sequence of SEQ ID NO: 274; $V_{L2}$ comprises a CDR-L1 comprising the sequence of SEQ ID NO: 275, a CDR-L2 comprising the sequence of SEQ ID NO: 276, and a CDR-L3 comprising the sequence of SEQ ID NO: 277; $V_{L3}$ comprises a CDR-L1 comprising the sequence of SEQ ID NO: 266, a CDR-L2 comprising the sequence of SEQ ID NO: 267, and a CDR-L3 comprising the sequence of SEQ ID NO: 268; $V_{H1}$ comprises a CDR-H1 comprising the sequence of SEQ ID NO: 254, a CDR-H2 comprising the sequence of SEQ ID NO: 255, and a CDR-H3 comprising the sequence of SEQ ID NO: 256; $V_{H2}$ comprises a CDR-H1 comprising the sequence of SEQ ID NO: 257, a CDR-H2 comprising the sequence of SEQ ID NO: 258, and a CDR-H3 comprising the sequence of SEQ ID NO: 259; and $V_{H3}$ comprises a CDR-H1 comprising the sequence of SEQ ID NO: 248, a CDR-H2 comprising the sequence of SEQ ID NO: 497, and a CDR-H3 comprising the sequence of SEQ ID NO: 250.

Item 27: The binding protein of any one of items 1-25, wherein $V_{L1}$ comprises a CDR-L1, CDR-L2, and CDR-L3 of a light chain variable domain comprising the light chain variable domain sequence of SEQ ID NO: 518; $V_{L2}$ comprises a CDR-L1, CDR-L2, and CDR-L3 of a light chain variable domain comprising the light chain variable domain sequence of SEQ ID NO: 519; $V_{L3}$ comprises a CDR-L1, CDR-L2, and CDR-L3 of a light chain variable domain comprising the light chain variable domain sequence of SEQ ID NO: 512; $V_{H1}$ comprises a CDR-H1, CDR-H2, and CDR-H3 of a heavy chain variable domain comprising the heavy chain variable domain sequence of SEQ ID NO: 504; $V_{H2}$ comprises a CDR-H1, CDR-H2, and CDR-H3 of a heavy chain variable domain comprising the heavy chain variable domain sequence of SEQ ID NO: 506; and $V_{H3}$ comprises a CDR-H1, CDR-H2, and CDR-H3 of a heavy chain variable domain comprising the heavy chain variable domain sequence of SEQ ID NO: 502.

Item 28: The binding protein of any one of items 1-27, wherein $V_{L1}$ comprises a light chain variable domain comprising the sequence of SEQ ID NO: 518; $V_{L2}$ comprises a light chain variable domain comprising the sequence of SEQ ID NO: 519; $V_{L3}$ comprises a light chain variable domain comprising the sequence of SEQ ID NO: 512; $V_{H1}$ comprises a heavy chain variable domain comprising the sequence of SEQ ID NO: 504; $V_{H2}$ comprises a heavy chain variable domain comprising the sequence of SEQ ID NO: 506; and $V_{H3}$ comprises a heavy chain variable domain comprising the sequence of SEQ ID NO: 502.

Item 29: The binding protein of any one of items 1-25, wherein $V_{L1}$ comprises a CDR-L1 comprising the sequence of SEQ ID NO: 500, a CDR-L2 comprising the sequence of SEQ ID NO: 501, and a CDR-L3 comprising the sequence of SEQ ID NO: 274; $V_{L2}$ comprises a CDR-L1 comprising the sequence of SEQ ID NO: 275, a CDR-L2 comprising the sequence of SEQ ID NO: 276, and a CDR-L3 comprising the sequence of SEQ ID NO: 277; $V_{L3}$ comprises a CDR-L1 comprising the sequence of SEQ ID NO: 269, a CDR-L2 comprising the sequence of SEQ ID NO: 270, and a CDR-L3 comprising the sequence of SEQ ID NO: 271; $V_{H1}$ comprises a CDR-H1 comprising the sequence of SEQ ID NO: 254, a CDR-H2 comprising the sequence of SEQ ID NO: 255, and a CDR-H3 comprising the sequence of SEQ ID NO: 256; $V_{H2}$ comprises a CDR-H1 comprising the sequence of SEQ ID NO: 257, a CDR-H2 comprising the sequence of SEQ ID NO: 258, and a CDR-H3 comprising the sequence of SEQ ID NO: 259; and $V_{H3}$ comprises a CDR-H1 comprising the sequence of SEQ ID NO: 251, a CDR-H2 comprising the sequence of SEQ ID NO: 252, and a CDR-H3 comprising the sequence of SEQ ID NO: 253.

Item 30: The binding protein of any one of items 1-25, wherein $V_{L1}$ comprises a CDR-L1, CDR-L2, and CDR-L3 of a light chain variable domain comprising the light chain variable domain sequence of SEQ ID NO: 518; $V_{L2}$ comprises a CDR-L1, CDR-L2, and CDR-L3 of a light chain variable domain comprising the light chain variable domain sequence of SEQ ID NO: 519; $V_{L3}$ comprises a CDR-L1, CDR-L2, and CDR-L3 of a light chain variable domain comprising the light chain variable domain sequence of SEQ ID NO: 513; $V_{H1}$ comprises a CDR-H1, CDR-H2, and CDR-H3 of a heavy chain variable domain comprising the heavy chain variable domain sequence of SEQ ID NO: 504; $V_{H2}$ comprises a CDR-H1, CDR-H2, and CDR-H3 of a heavy chain variable domain comprising the heavy chain variable domain sequence of SEQ ID NO: 506; and $V_{H3}$ comprises a CDR-H1, CDR-H2, and CDR-H3 of a heavy chain variable domain comprising the heavy chain variable domain sequence of SEQ ID NO: 503.

Item 31: The binding protein of any one of items 1-25 and 29-30, wherein $V_{L1}$ comprises a light chain variable domain comprising the sequence of SEQ ID NO: 518; $V_{L2}$ comprises a light chain variable domain comprising the sequence of SEQ ID NO: 519; $V_{L3}$ comprises a light chain variable domain comprising the sequence of SEQ ID NO: 513; $V_{H1}$ comprises a heavy chain variable domain comprising the sequence of SEQ ID NO: 504; $V_{H2}$ comprises a heavy chain variable domain comprising the sequence of SEQ ID NO: 506; and $V_{H3}$ comprises a heavy chain variable domain comprising the sequence of SEQ ID NO: 503.

Item 32: The binding protein of any one of items 1-25, wherein $V_{L1}$ comprises a CDR-L1 comprising the sequence of SEQ ID NO: 275, a CDR-L2 comprising the sequence of SEQ ID NO: 276, and a CDR-L3 comprising the sequence of SEQ ID NO: 277; $V_{L2}$ comprises a CDR-L1 comprising the sequence of SEQ ID NO: 500, a CDR-L2 comprising the sequence of SEQ ID NO: 501, and a CDR-L3 comprising the sequence of SEQ ID NO: 274; $V_{L3}$ comprises a CDR-L1 comprising the sequence of SEQ ID NO: 269, a CDR-L2 comprising the sequence of SEQ ID NO: 270, and a CDR-L3 comprising the sequence of SEQ ID NO: 271; $V_{H1}$ comprises a CDR-H1 comprising the sequence of SEQ ID NO: 257, a CDR-H2 comprising the sequence of SEQ ID NO: 258, and a CDR-H3 comprising the sequence of SEQ ID NO: 259; $V_{H2}$ comprises a CDR-H1 comprising the sequence of SEQ ID NO: 254, a CDR-H2 comprising the sequence of SEQ ID NO: 255, and a CDR-H3 comprising the sequence of SEQ ID NO: 256; and $V_{H3}$ comprises a CDR-H1 comprising the sequence of SEQ ID NO: 251, a CDR-H2 comprising the sequence of SEQ ID NO: 252, and a CDR-H3 comprising the sequence of SEQ ID NO: 253.

Item 33: The binding protein of any one of items 1-25, wherein $V_{L1}$ comprises a CDR-L1, CDR-L2, and CDR-L3 of a light chain variable domain comprising the light chain variable domain sequence of SEQ ID NO: 519; $V_{L2}$ comprises a CDR-L1, CDR-L2, and CDR-L3 of a light chain variable domain comprising the light chain variable domain sequence of SEQ ID NO: 518; $V_{L3}$ comprises a CDR-L1, CDR-L2, and CDR-L3 of a light chain variable domain comprising the light chain variable domain sequence of SEQ ID NO: 513; $V_{H1}$ comprises a CDR-H1, CDR-H2, and CDR-H3 of a heavy chain variable domain comprising the heavy chain variable domain sequence of SEQ ID NO: 506; $V_{H2}$ comprises a CDR-H1, CDR-H2, and CDR-H3 of a heavy chain variable domain comprising the heavy chain variable domain sequence of SEQ ID NO: 504; and $V_{H3}$ comprises a CDR-H1, CDR-H2, and CDR-H3 of a heavy chain variable domain comprising the heavy chain variable domain sequence of SEQ ID NO: 503.

Item 34: The binding protein of any one of items 1-25 and 32-33, wherein $V_{L1}$ comprises a light chain variable domain comprising the sequence of SEQ ID NO: 519; $V_{L2}$ comprises a light chain variable domain comprising the sequence of SEQ ID NO: 518; $V_{L3}$ comprises a light chain variable domain comprising the sequence of SEQ ID NO: 513; $V_{H1}$ comprises a heavy chain variable domain comprising the sequence of SEQ ID NO: 506; $V_{H2}$ comprises a heavy chain variable domain comprising the sequence of SEQ ID NO: 504; and $V_{H3}$ comprises a heavy chain variable domain comprising the sequence of SEQ ID NO: 503.

Item 35: The binding protein of item 1, wherein the second polypeptide chain further comprises an Fc region linked to $C_{H1}$, the Fc region comprising an immunoglobulin hinge region and $C_{H2}$ and $C_{H3}$ immunoglobulin heavy chain constant domains.

Item 36: The binding protein of item 1, wherein the third polypeptide chain further comprises an Fc region linked to $C_{H1}$, the Fc region comprising an immunoglobulin hinge region and $C_{H2}$ and $C_{H3}$ immunoglobulin heavy chain constant domains.

Item 37: The binding protein of item 1, wherein the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 354 and 366 of human IgG1 according to EU Index, wherein the amino acid substitutions are S354C and T366W; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 349, 366, 368, and 407 of human IgG1 according to EU Index, wherein the amino acid substitutions are Y349C, T366S, L368A, and Y407V.

Item 38: The binding protein of item 1, wherein the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 349, 366, 368, and 407 of human IgG1 according to EU Index, wherein the amino acid substitutions are Y349C, T366S, L368A, and Y407V; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 354 and 366 of human IgG1 according to EU Index, wherein the amino acid substitutions are S354C and T366W.

Item 39: The binding protein of any one of items 1, 37, and 38, wherein the second polypeptide chain further comprises a first Fc region linked to $C_{H1}$, the first Fc region comprising an immunoglobulin hinge region and $C_{H2}$ and $C_{H3}$ immunoglobulin heavy chain constant domains, and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains; wherein the first and second Fc regions comprise amino acid substitutions at positions corresponding to positions 428 and 434 of human IgG1 according to EU Index, wherein the amino acid substitutions are M428L and N434S.

Item 40: The binding protein of item 2, wherein the $C_{H3}$ domain of the second polypeptide chain comprises amino acid substitutions at positions corresponding to positions 354 and 366 of human IgG1 according to EU Index, wherein the amino acid substitutions are S354C and T366W; and wherein the $C_{H3}$ domain of the third polypeptide chain comprises amino acid substitutions at positions corresponding to positions 349, 366, 368, and 407 of human IgG1 according to EU Index, wherein the amino acid substitutions are Y349C, T366S, L368A, and Y407V.

Item 41: The binding protein of item 2, wherein the $C_{H3}$ domain of the second polypeptide chain comprises amino acid substitutions at positions corresponding to positions 349, 366, 368, and 407 of human IgG1 according to EU Index, wherein the amino acid substitutions are Y349C, T366S, L368A, and Y407V; and wherein the $C_{H3}$ domain of the third polypeptide chain comprises amino acid substitutions at positions corresponding to positions 354 and 366 of human IgG1 according to EU Index, wherein the amino acid substitutions are S354C and T366W.

Item 42: The binding protein of any one of items 2, 40, and 41, wherein the $C_{H3}$ domains of the second and the third polypeptide chains both comprise amino acid substitutions at positions corresponding to positions 428 and 434 of human IgG1 according to EU Index, wherein the amino acid substitutions are M428L and N434S.

Item 43: The binding protein of item 1 or item 2, wherein at least one of $L_1$, $L_2$, $L_3$, or $L_4$ is independently 0 amino acids in length.

Item 44: The binding protein of item 1 or item 2, wherein $L_1$, $L_2$, $L_3$, or $L_4$ are each independently at least one amino acid in length.

Item 45: The binding protein of any one of items 1-44, wherein $L_1$ comprises Asp-Lys-Thr-His-Thr (SEQ ID NO: 525).

Item 46: A binding protein comprising four polypeptide chains that form three antigen binding sites, wherein a first polypeptide chain comprises a structure represented by the formula:

$$V_{L2}\text{-}L_1\text{-}V_{L1}\text{-}L_2\text{-}C_L \qquad [\text{I}]$$

and a second polypeptide chain comprises a structure represented by the formula:

$$V_{H1}\text{-}L_3\text{-}V_{H2}\text{-}L_4\text{-}C_{H1} \qquad [\text{II}]$$

and a third polypeptide chain comprises a structure represented by the formula:

$$V_{H3}\text{-}C_{H1} \qquad [\text{III}]$$

and a fourth polypeptide chain comprises a structure represented by the formula:

$$V_{L3}\text{-}C_L \qquad [\text{IV}]$$

wherein:

$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$, and $L_4$ are amino acid linkers;
wherein the polypeptide of formula I and the polypeptide of formula II form a cross-over light chain-heavy chain pair;
wherein:

(a) $V_{L1}$, $V_{L2}$ and $V_{L3}$ are each independently a variable domain derived from an amino acid sequence as set forth in any one of SEQ ID NOs: 2, 4, 10, 12, 18, 20, 26, 28, 34, 36, 42, 44, 50, 52, 58, 60, 66, 68, 74, 76, 82, 84, 90, 92, 98, 100, 106, 108, 114, 116, 122, 124, 130, 132, 138, 140, 146, 148, 154, 156, 162, 164, 170, 172, 178, 180, 186, 188, 194, 196, 202, 204, 210,212, 218, 220, 226, 228, 233, 235, 241, 243; or (b) $V_{L1}$, $V_{L2}$ and $V_{L3}$ each independently comprise light chain complementarity determining regions of a variable domain comprising an amino acid sequence as set forth in any one of SEQ ID NOs:266-283; and
wherein:
(a) $V_{H1}$, $V_{H2}$, and $V_{H3}$ are each independently a variable domain derived from an amino acid sequence as set forth in any one of SEQ ID NOs: 1, 3, 9, 11, 17, 10, 25, 27, 33, 35, 41, 43, 49, 51, 57, 59, 65, 67, 73, 75, 81, 83, 89, 91, 97, 99, 105, 107, 113, 115, 121, 123, 129, 131, 137, 139, 145, 147, 153, 155, 161, 163, 169, 171, 177, 179, 185, 187, 193, 195, 201, 203, 209, 211, 217, 219, 225, 227, 232, 234, 240, 242; or
(b) $V_{H1}$, $V_{H2}$, and $V_{H3}$ each independently comprise heavy chain complementarity determining regions of a variable domain comprising an amino acid sequence as set forth in any one of SEQ ID NOs: 248-265.

Item 47: A binding protein comprising four polypeptide chains that form three antigen binding sites, wherein a first polypeptide chain comprises a structure represented by the formula:

$$V_{L2}\text{-}L_1\text{-}V_{L1}\text{-}L_2\text{-}C_L \qquad [I]$$

and a second polypeptide chain comprises a structure represented by the formula:

$$V_{H1}\text{-}L_3\text{-}V_{H2}\text{-}L_4\text{-}C_{H1}\text{-}\text{hinge-}C_{H2}\text{-}C_{H3} \qquad [II]$$

and a third polypeptide chain comprises a structure represented by the formula:

$$V_{H3}\text{-}C_{H1}\text{-}\text{hinge-}C_{H2}\text{-}C_{H3} \qquad [III]$$

and a fourth polypeptide chain comprises a structure represented by the formula:

$$V_{L3}\text{-}C_L \qquad [IV]$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain;
$C_{H2}$ is an immunoglobulin $C_{H2}$ heavy chain constant domain;
$C_{H3}$ is an immunoglobulin $C_{H3}$ heavy chain constant domain;
hinge is an immunoglobulin hinge region connecting the $C_{H1}$ and $C_{H2}$ domains; and
$L_1$, $L_2$, $L_3$, and $L_4$ are amino acid linkers;
wherein the polypeptide of formula I and the polypeptide of formula II form a cross-over light chain-heavy chain pair;
wherein:
(a) $V_{L1}$, $V_{L2}$ and $V_{L3}$ are each independently a variable domain derived from an amino acid sequence as set forth in any one of SEQ ID NOs: 2, 4, 10, 12, 18, 20, 26, 28, 34, 36, 42, 44, 50, 52, 58, 60, 66, 68, 74, 76, 82, 84, 90, 92, 98, 100, 106, 108, 114, 116, 122, 124, 130, 132, 138, 140, 146, 148, 154, 156, 162, 164, 170, 172, 178, 180, 186, 188, 194, 196, 202, 204, 210, 212, 218, 220, 226, 228, 233, 235, 241, 243; or
(b) $V_{L1}$, $V_{L2}$ and $V_{L3}$ each independently comprise light chain complementarity determining regions of a variable domain comprising an amino acid sequence as set forth in any one of SEQ ID NOs:266-283; and
wherein:
(a) $V_{H1}$, $V_{H2}$, and $V_{H3}$ are each independently a variable domain derived from an amino acid sequence as set forth in any one of SEQ ID NOs: 1, 3, 9, 11, 17, 10, 25, 27, 33, 35, 41, 43, 49, 51, 57, 59, 65, 67, 73, 75, 81, 83, 89, 91, 97, 99, 105, 107, 113, 115, 121, 123, 129, 131, 137, 139, 145, 147, 153, 155, 161, 163, 169, 171, 177, 179, 185, 187, 193, 195, 201, 203, 209, 211, 217, 219, 225, 227, 232, 234, 240, 242; or
(b) $V_{H1}$, $V_{H2}$, and $V_{H3}$ each independently comprise heavy chain complementarity determining regions of a variable domain comprising an amino acid sequence as set forth in any one of SEQ ID NOs: 248-265.

Item 48: The binding protein of item 46, wherein the second polypeptide chain further comprises an Fc region linked to $C_{H1}$, the Fc region comprising an immunoglobulin hinge region and $C_{H2}$ and $C_{H3}$ immunoglobulin heavy chain constant domains.

Item 49: The binding protein of item 46, wherein the third polypeptide chain further comprises an Fc region linked to $C_{H1}$, the Fc region comprising an immunoglobulin hinge region and $C_{H2}$ and $C_{H3}$ immunoglobulin heavy chain constant domains.

Item 50: The binding protein of item 46, wherein the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 354 and 366 of human IgG1 according to EU Index, wherein the amino acid substitutions are S354C and T366W; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 349, 366, 368, and 407 of human IgG1 according to EU Index, wherein the amino acid substitutions are Y349C, T366S, L368A, and Y407V.

Item 51: The binding protein of item 46, wherein the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 349, 366, 368, and 407 of human IgG1 according to EU Index, wherein the amino acid substitutions are Y349C, T366S, L368A, and Y407V; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 354 and 366 of human IgG1 according to EU Index, wherein the amino acid substitutions are S354C and T366W.

Item 52: The binding protein of any one of items 46, 50, and 51, wherein the second polypeptide chain further comprises a first Fc region linked to $C_{H1}$, the first Fc region comprising an immunoglobulin hinge region and $C_{H2}$ and $C_{H3}$ immunoglobulin heavy chain constant domains, and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains; wherein the first and second Fc regions comprise amino acid substitutions at positions corresponding to positions 428 and 434 of human IgG1 according to EU Index, wherein the amino acid substitutions are M428L and N434S.

Item 53: The binding protein of item 47, wherein the C$_{H3}$ domain of the second polypeptide chain comprises amino acid substitutions at positions corresponding to positions 354 and 366 of human IgG1 according to EU Index, wherein the amino acid substitutions are S354C and T366W; and wherein the C$_{H3}$ domain of the third polypeptide chain comprises amino acid substitutions at positions corresponding to positions 349, 366, 368, and 407 of human IgG1 according to EU Index, wherein the amino acid substitutions are Y349C, T366S, L368A, and Y407V.

Item 54: The binding protein of item 47, wherein the C$_{H3}$ domain of the second polypeptide chain comprises amino acid substitutions at positions corresponding to positions 349, 366, 368, and 407 of human IgG1 according to EU Index, wherein the amino acid substitutions are Y349C, T366S, L368A, and Y407V; and wherein the C$_{H3}$ domain of the third polypeptide chain comprises amino acid substitutions at positions corresponding to positions 354 and 366 of human IgG1 according to EU Index, wherein the amino acid substitutions are S354C and T366W.

Item 55: The binding protein of any one of items 47, 53, and 54, wherein the C$_{H3}$ domains of the second and the third polypeptide chains both comprise amino acid substitutions at positions corresponding to positions 428 and 434 of human IgG1 according to EU Index, wherein the amino acid substitutions are M428L and N434S.

Item 56: The binding protein of item 46 or item 47, wherein at least one of L$_1$, L$_2$, L$_3$ or L$_4$ is independently 0 amino acids in length.

Item 57: The binding protein of item 46 or item 47, wherein L$_1$, L$_2$, L$_3$ or L$_4$ are each independently at least one amino acid in length.

Item 58: The binding protein of any one of items 46-57, wherein L$_1$ comprises Asp-Lys-Thr-His-Thr (SEQ ID NO: 525).

Item 59: A binding protein comprising a first polypeptide chain, a second polypeptide chain, a third polypeptide chain and a fourth polypeptide chain wherein:

(a) the first polypeptide chain comprises the amino acid sequence of SEQ ID NO: 4 or an amino acid sequence that is at least 95% identical to the amino acid sequence of SEQ ID NO: 4; the second polypeptide chain comprises the amino acid sequence of SEQ ID NO: 3 or an amino acid sequence that is at least 95% identical to the amino acid sequence of SEQ ID NO: 3; the third polypeptide chain comprises the amino acid sequence of SEQ ID NO: 1 or an amino acid sequence that is at least 95% identical to the amino acid sequence of SEQ ID NO: 1; and the fourth polypeptide chain comprises the amino acid sequence of SEQ ID NO: 2 or an amino acid sequence that is at least 95% identical to the amino acid sequence of SEQ ID NO: 2;

(b) the first polypeptide chain comprises the amino acid sequence of SEQ ID NO: 12 or an amino acid sequence that is at least 95% identical to the amino acid sequence of SEQ ID NO: 12; the second polypeptide chain comprises the amino acid sequence of SEQ ID NO: 11 or an amino acid sequence that is at least 95% identical to the amino acid sequence of SEQ ID NO: 11; the third polypeptide chain comprises the amino acid sequence of SEQ ID NO: 9 or an amino acid sequence that is at least 95% identical to the amino acid sequence of SEQ ID NO: 9; and the fourth polypeptide chain comprises the amino acid sequence of SEQ ID NO: 10 or an amino acid sequence that is at least 95% identical to the amino acid sequence of SEQ ID NO: 10;

(c) the first polypeptide chain comprises the amino acid sequence of SEQ ID NO: 20 or an amino acid sequence that is at least 95% identical to the amino acid sequence of SEQ ID NO: 20; the second polypeptide chain comprises the amino acid sequence of SEQ ID NO: 19 or an amino acid sequence that is at least 95% identical to the amino acid sequence of SEQ ID NO: 19; the third polypeptide chain comprises the amino acid sequence of SEQ ID NO: 17 or an amino acid sequence that is at least 95% identical to the amino acid sequence of SEQ ID NO: 17; and the fourth polypeptide chain comprises the amino acid sequence of SEQ ID NO: 18 or an amino acid sequence that is at least 95% identical to the amino acid sequence of SEQ ID NO: 18;

(d) the first polypeptide chain comprises the amino acid sequence of SEQ ID NO: 28 or an amino acid sequence that is at least 95% identical to the amino acid sequence of SEQ ID NO: 28; the second polypeptide chain comprises the amino acid sequence of SEQ ID NO: 27 or an amino acid sequence that is at least 95% identical to the amino acid sequence of SEQ ID NO: 27; the third polypeptide chain comprises the amino acid sequence of SEQ ID NO: 25 or an amino acid sequence that is at least 95% identical to the amino acid sequence of SEQ ID NO: 25; and the fourth polypeptide chain comprises the amino acid sequence of SEQ ID NO: 26 or an amino acid sequence that is at least 95% identical to the amino acid sequence of SEQ ID NO: 26;

(e) the first polypeptide chain comprises the amino acid sequence of SEQ ID NO: 36 or an amino acid sequence that is at least 95% identical to the amino acid sequence of SEQ ID NO: 36; the second polypeptide chain comprises the amino acid sequence of SEQ ID NO: 35 or an amino acid sequence that is at least 95% identical to the amino acid sequence of SEQ ID NO: 35; the third polypeptide chain comprises the amino acid sequence of SEQ ID NO: 33 or an amino acid sequence that is at least 95% identical to the amino acid sequence of SEQ ID NO: 33; and the fourth polypeptide chain comprises the amino acid sequence of SEQ ID NO: 34 or an amino acid sequence that is at least 95% identical to the amino acid sequence of SEQ ID NO: 34;

(f) the first polypeptide chain comprises the amino acid sequence of SEQ ID NO: 44 or an amino acid sequence that is at least 95% identical to the amino acid sequence of SEQ ID NO: 44; the second polypeptide chain comprises the amino acid sequence of SEQ ID NO: 43 or an amino acid sequence that is at least 95% identical to the amino acid sequence of SEQ ID NO: 43; the third polypeptide chain comprises the amino acid sequence of SEQ ID NO: 41 or an amino acid sequence that is at least 95% identical to the amino acid sequence of SEQ ID NO: 41; and the fourth polypeptide chain comprises the amino acid sequence of SEQ ID NO: 42 or an amino acid sequence that is at least 95% identical to the amino acid sequence of SEQ ID NO: 42;

(g) the first polypeptide chain comprises the amino acid sequence of SEQ ID NO: 52 or an amino acid sequence that is at least 95% identical to the amino acid sequence of SEQ ID NO: 52; the second polypeptide chain comprises the amino acid sequence of SEQ ID NO: 51 or an amino acid sequence that is at least 95% identical to the amino acid sequence of SEQ ID NO: 51; the third polypeptide chain comprises the amino acid sequence of SEQ ID NO: 49 or an amino acid sequence that is at least 95% identical to the amino acid sequence of SEQ ID NO: 49; and the fourth polypeptide chain comprises the amino acid sequence of SEQ ID NO: 50 or an amino acid sequence that is at least 95% identical to the amino acid sequence of SEQ ID NO: 50;

(h) the first polypeptide chain comprises the amino acid sequence of SEQ ID NO: 60 or an amino acid sequence that is at least 95% identical to the amino acid sequence of SEQ ID NO: 60; the second polypeptide chain comprises the amino acid sequence of SEQ ID NO: 59 or an amino acid sequence that is at least 95% identical to the amino acid sequence of SEQ ID NO: 59; the third polypeptide chain comprises the amino acid sequence of SEQ ID NO: 57 or an amino acid sequence that is at least 95% identical to the amino acid sequence of SEQ ID NO: 57; and the fourth polypeptide chain comprises the amino acid sequence of SEQ ID NO: 58 or an amino acid sequence that is at least 95% identical to the amino acid sequence of SEQ ID NO: 58;

(i) the first polypeptide chain comprises the amino acid sequence of SEQ ID NO: 68 or an amino acid sequence that is at least 95% identical to the amino acid sequence of SEQ ID NO: 68; the second polypeptide chain comprises the amino acid sequence of SEQ ID NO: 67 or an amino acid sequence that is at least 95% identical to the amino acid sequence of SEQ ID NO: 67; the third polypeptide chain comprises the amino acid sequence of SEQ ID NO: 65 or an amino acid sequence that is at least 95% identical to the amino acid sequence of SEQ ID NO: 65; and the fourth polypeptide chain comprises the amino acid sequence of SEQ ID NO: 66 or an amino acid sequence that is at least 95% identical to the amino acid sequence of SEQ ID NO: 66;

(j) the first polypeptide chain comprises the amino acid sequence of SEQ ID NO: 76 or an amino acid sequence that is at least 95% identical to the amino acid sequence of SEQ ID NO: 76; the second polypeptide chain comprises the amino acid sequence of SEQ ID NO: 75 or an amino acid sequence that is at least 95% identical to the amino acid sequence of SEQ ID NO: 75; the third polypeptide chain comprises the amino acid sequence of SEQ ID NO: 73 or an amino acid sequence that is at least 95% identical to the amino acid sequence of SEQ ID NO: 73; and the fourth polypeptide chain comprises the amino acid sequence of SEQ ID NO: 74 or an amino acid sequence that is at least 95% identical to the amino acid sequence of SEQ ID NO: 74;

(k) the first polypeptide chain comprises the amino acid sequence of SEQ ID NO: 84 or an amino acid sequence that is at least 95% identical to the amino acid sequence of SEQ ID NO: 84; the second polypeptide chain comprises the amino acid sequence of SEQ ID NO: 83 or an amino acid sequence that is at least 95% identical to the amino acid sequence of SEQ ID NO: 83; the third polypeptide chain comprises the amino acid sequence of SEQ ID NO: 81 or an amino acid sequence that is at least 95% identical to the amino acid sequence of SEQ ID NO: 81; and the fourth polypeptide chain comprises the amino acid sequence of SEQ ID NO: 82 or an amino acid sequence that is at least 95% identical to the amino acid sequence of SEQ ID NO: 82;

(l) the first polypeptide chain comprises the amino acid sequence of SEQ ID NO: 92 or an amino acid sequence that is at least 95% identical to the amino acid sequence of SEQ ID NO:92; the second polypeptide chain comprises the amino acid sequence of SEQ ID NO: 91 or an amino acid sequence that is at least 95% identical to the amino acid sequence of SEQ ID NO: 91; the third polypeptide chain comprises the amino acid sequence of SEQ ID NO: 89 or an amino acid sequence that is at least 95% identical to the amino acid sequence of SEQ ID NO: 89; and the fourth polypeptide chain comprises the amino acid sequence of SEQ ID NO: 90 or an amino acid sequence that is at least 95% identical to the amino acid sequence of SEQ ID NO: 90;

(m) the first polypeptide chain comprises the amino acid sequence of SEQ ID NO: 100 or an amino acid sequence that is at least 95% identical to the amino acid sequence of SEQ ID NO: 100; the second polypeptide chain comprises the amino acid sequence of SEQ ID NO: 99 or an amino acid sequence that is at least 95% identical to the amino acid sequence of SEQ ID NO: 99; the third polypeptide chain comprises the amino acid sequence of SEQ ID NO: 97 or an amino acid sequence that is at least 95% identical to the amino acid sequence of SEQ ID NO: 97; and the fourth polypeptide chain comprises the amino acid sequence of SEQ ID NO: 98 or an amino acid sequence that is at least 95% identical to the amino acid sequence of SEQ ID NO: 98;

(n) the first polypeptide comprises the amino acid sequence of SEQ ID NO: 108 or an amino acid sequence that is at least 95% identical to the amino acid sequence of SEQ ID NO: 108; the second polypeptide chain comprises the amino acid sequence of SEQ ID NO: 107 or an amino acid sequence that is at least 95% identical to the amino acid sequence of SEQ ID NO: 107; the third polypeptide chain comprises the amino acid sequence of SEQ ID NO: 105 or an amino acid sequence that is at least 95% identical to the amino acid sequence of SEQ ID NO: 105; and the fourth polypeptide chain comprises the amino acid sequence of SEQ ID NO: 106 or an amino acid sequence that is at least 95% identical to the amino acid sequence of SEQ ID NO: 106;

(o) the first polypeptide chain comprises the amino acid sequence of SEQ ID NO: 116 or an amino acid sequence that is at least 95% identical to the amino acid sequence of SEQ ID NO: 116; the second polypeptide chain comprises the amino acid sequence of SEQ ID NO: 115 or an amino acid sequence that is at least 95% identical to the amino acid sequence of SEQ ID NO: 115; the third polypeptide chain comprises the amino acid sequence of SEQ ID NO: 113 or an amino acid sequence that is at least 95% identical to the amino acid sequence of SEQ ID NO: 113; and the fourth polypeptide chain comprises the amino acid sequence of SEQ ID NO: 114 or an amino acid sequence that is at least 95% identical to the amino acid sequence of SEQ ID NO: 114;

(p) the first polypeptide chain comprises the amino acid sequence of SEQ ID NO: 124 or an amino acid sequence that is at least 95% identical to the amino acid sequence of SEQ ID NO: 124; the second polypeptide chain comprises the amino acid sequence of SEQ ID NO: 123 or an amino acid sequence that is at least 95% identical to the amino acid sequence of SEQ ID NO: 123; the third polypeptide chain comprises the amino acid sequence of SEQ ID NO: 121 or an amino acid sequence that is at least 95% identical to the amino acid sequence of SEQ ID NO: 121; and the fourth polypeptide chain comprises the amino acid sequence of SEQ ID NO: 122 or an amino acid sequence that is at least 95% identical to the amino acid sequence of SEQ ID NO: 122;

(q) the first polypeptide chain comprises the amino acid sequence of SEQ ID NO: 132 or an amino acid sequence that is at least 95% identical to the amino acid sequence of SEQ ID NO: 132; the second polypeptide chain comprises the amino acid sequence of SEQ ID NO: 131 or an amino acid sequence that is at least 95% identical to the amino acid sequence of SEQ ID NO: 131; the third polypeptide chain comprises the amino acid sequence of SEQ ID NO: 129 or an amino acid sequence that is at least 95% identical to the amino acid sequence of SEQ ID NO: 129; and the fourth polypeptide chain comprises the amino acid sequence of SEQ ID NO: 130 or an amino acid sequence that is at least 95% identical to the amino acid sequence of SEQ ID NO: 130;

(r) the first polypeptide chain comprises the amino acid sequence of SEQ ID NO: 140 or an amino acid sequence that is at least 95% identical to the amino acid sequence of SEQ ID NO: 140; the second polypeptide chain comprises the amino acid sequence of SEQ ID NO: 139 or an amino acid sequence that is at least 95% identical to the amino acid sequence of SEQ ID NO: 139; the third polypeptide chain comprises the amino acid sequence of SEQ ID NO: 137 or an amino acid sequence that is at least 95% identical to the amino acid sequence of SEQ ID NO: 137; and the fourth polypeptide chain comprises the amino acid sequence of SEQ ID NO: 138 or an amino acid sequence that is at least 95% identical to the amino acid sequence of SEQ ID NO: 138;

(s) the first polypeptide chain comprises the amino acid sequence of SEQ ID NO: 148 or an amino acid sequence that is at least 95% identical to the amino acid sequence of SEQ ID NO: 148; the second polypeptide chain comprises the amino acid sequence of SEQ ID NO: 147 or an amino acid sequence that is at least 95% identical to the amino acid sequence of SEQ ID NO: 147; the third polypeptide chain comprises the amino acid sequence of SEQ ID NO: 145 or an amino acid sequence that is at least 95% identical to the amino acid sequence of SEQ ID NO: 145; and the fourth polypeptide chain comprises the amino acid sequence of SEQ ID NO: 146 or an amino acid sequence that is at least 95% identical to the amino acid sequence of SEQ ID NO: 146;

(t) the first polypeptide chain comprises the amino acid sequence of SEQ ID NO: 156 or an amino acid sequence that is at least 95% identical to the amino acid sequence of SEQ ID NO: 156; the second polypeptide chain comprises the amino acid sequence of SEQ ID NO: 155 or an amino acid sequence that is at least 95% identical to the amino acid sequence of SEQ ID NO: 155; the third polypeptide chain comprises the amino acid sequence of SEQ ID NO: 153 or an amino acid sequence that is at least 95% identical to the amino acid sequence of SEQ ID NO: 153; and the fourth polypeptide chain comprises the amino acid sequence of SEQ ID NO: 154 or an amino acid sequence that is at least 95% identical to the amino acid sequence of SEQ ID NO: 154;

(u) the first polypeptide chain comprises the amino acid sequence of SEQ ID NO: 164 or an amino acid sequence that is at least 95% identical to the amino acid sequence of SEQ ID NO: 164; the second polypeptide chain comprises the amino acid sequence of SEQ ID NO: 163 or an amino acid sequence that is at least 95% identical to the amino acid sequence of SEQ ID NO: 163; the third polypeptide chain comprises the amino acid sequence of SEQ ID NO: 161 or an amino acid sequence that is at least 95% identical to the amino acid sequence of SEQ ID NO: 161; and the fourth polypeptide chain comprises the amino acid sequence of SEQ ID NO: 162 or an amino acid sequence that is at least 95% identical to the amino acid sequence of SEQ ID NO: 162;

(v) the first polypeptide chain comprises the amino acid sequence of SEQ ID NO: 172 or an amino acid sequence that is at least 95% identical to the amino acid sequence of SEQ ID NO: 172; the second polypeptide chain comprises the amino acid sequence of SEQ ID NO: 171 or an amino acid sequence that is at least 95% identical to the amino acid sequence of SEQ ID NO: 171; the third polypeptide chain comprises the amino acid sequence of SEQ ID NO: 169 or an amino acid sequence that is at least 95% identical to the amino acid sequence of SEQ ID NO: 169; and the fourth polypeptide chain comprises the amino acid sequence of SEQ ID NO: 170 or an amino acid sequence that is at least 95% identical to the amino acid sequence of SEQ ID NO: 170;

(w) the first polypeptide chain comprises the amino acid sequence of SEQ ID NO: 180 or an amino acid sequence that is at least 95% identical to the amino acid sequence of SEQ ID NO: 180; the second polypeptide chain comprises the amino acid sequence of SEQ ID NO: 179 or an amino acid sequence that is at least 95% identical to the amino acid sequence of SEQ ID NO: 179; the third polypeptide chain comprises the amino acid sequence of SEQ ID NO: 177 or an amino acid sequence that is at least 95% identical to the amino acid sequence of SEQ ID NO: 177; and the fourth polypeptide chain comprises the amino acid sequence of SEQ ID NO: 178 or an amino acid sequence that is at least 95% identical to the amino acid sequence of SEQ ID NO: 178;

(x) the first polypeptide chain comprises the amino acid sequence of SEQ ID NO: 188 or an amino acid sequence that is at least 95% identical to the amino acid sequence of SEQ ID NO: 188; the second polypeptide chain comprises the amino acid sequence of SEQ ID NO: 187 or an amino acid sequence that is at least 95% identical to the amino acid sequence of SEQ ID NO: 187; the third polypeptide chain comprises the amino acid sequence of SEQ ID NO: 185 or an amino acid sequence that is at least 95% identical to the amino acid sequence of SEQ ID NO: 185; and the fourth polypeptide chain comprises the amino acid sequence of SEQ ID NO: 186 or an amino acid sequence that is at least 95% identical to the amino acid sequence of SEQ ID NO: 186;

(y) the first polypeptide chain comprises the amino acid sequence of SEQ ID NO: 196 or an amino acid sequence that is at least 95% identical to the amino acid sequence of SEQ ID NO: 196; the second polypeptide chain comprises the amino acid sequence of SEQ ID NO: 195 or an amino acid sequence that is at least 95% identical to the amino acid sequence of SEQ ID NO: 195; the third polypeptide chain comprises the amino acid sequence of SEQ ID NO: 193 or an amino acid sequence that is at least 95% identical to the amino acid sequence of SEQ ID NO: 193; and the fourth polypeptide chain comprises the amino acid sequence of SEQ ID NO: 194 or an amino acid sequence that is at least 95% identical to the amino acid sequence of SEQ ID NO: 194;

(z) the first polypeptide chain comprises the amino acid sequence of SEQ ID NO: 204 or an amino acid sequence that is at least 95% identical to the amino acid sequence of SEQ ID NO: 204; the second polypeptide chain comprises the amino acid sequence of SEQ ID NO: 203 or an amino acid sequence that is at least 95% identical to the amino acid sequence of SEQ ID NO: 203; the third polypeptide chain comprises the amino acid sequence of SEQ ID NO: 201 or an amino acid sequence that is at least 95% identical to the amino acid sequence of SEQ ID NO: 201; and the fourth polypeptide chain comprises the amino acid sequence of SEQ ID NO: 202 or an amino acid sequence that is at least 95% identical to the amino acid sequence of SEQ ID NO: 202;

(aa) the first polypeptide chain comprises the amino acid sequence of SEQ ID NO: 212 or an amino acid sequence that is at least 95% identical to the amino acid sequence of SEQ ID NO: 212; the second polypeptide chain comprises the amino acid sequence of SEQ ID NO: 211 or an amino acid sequence that is at least 95% identical to the amino acid sequence of SEQ ID NO: 211; the third polypeptide chain comprises the amino acid sequence of SEQ ID NO: 209 or an amino acid sequence that is at least 95% identical to the amino acid sequence of SEQ ID NO: 209; and the fourth polypeptide chain comprises the amino acid sequence of SEQ ID NO: 210 or an amino acid sequence that is at least 95% identical to the amino acid sequence of SEQ ID NO: 210;

(bb) the first polypeptide chain comprises the amino acid sequence of SEQ ID NO: 220 or an amino acid sequence that is at least 95% identical to the amino acid sequence of SEQ ID NO: 220; the second polypeptide chain comprises the amino acid sequence of SEQ ID NO: 219 or an amino acid sequence that is at least 95% identical to the amino acid sequence of SEQ ID NO: 219; the third polypeptide chain comprises the amino acid sequence of SEQ ID NO: 217 or an amino acid sequence that is at least 95% identical to the amino acid sequence of SEQ ID NO: 217; and the fourth polypeptide chain comprises the amino acid sequence of SEQ ID NO: 218 or an amino acid sequence that is at least 95% identical to the amino acid sequence of SEQ ID NO: 218;

(cc) the first polypeptide chain comprises the amino acid sequence of SEQ ID NO: 228 or an amino acid sequence that is at least 95% identical to the amino acid sequence of SEQ ID NO: 228; the second polypeptide chain comprises the amino acid sequence of SEQ ID NO: 227 or an amino acid sequence that is at least 95% identical to the amino acid sequence of SEQ ID NO: 227; the third polypeptide chain comprises the amino acid sequence of SEQ ID NO: 225 or an amino acid sequence that is at least 95% identical to the amino acid sequence of SEQ ID NO: 225; and the fourth polypeptide chain comprises the amino acid sequence of SEQ ID NO: 226 or an amino acid sequence that is at least 95% identical to the amino acid sequence of SEQ ID NO: 226;

(dd) the first polypeptide chain comprises the amino acid sequence of SEQ ID NO: 235 or an amino acid sequence that is at least 95% identical to the amino acid sequence of SEQ ID NO: 235; the second polypeptide chain comprises the amino acid sequence of SEQ ID NO: 234 or an amino acid sequence that is at least 95% identical to the amino acid sequence of SEQ ID NO: 234; the third polypeptide chain comprises the amino acid sequence of SEQ ID NO: 232 or an amino acid sequence that is at least 95% identical to the amino acid sequence of SEQ ID NO: 232; and the fourth polypeptide chain comprises the amino acid sequence of SEQ ID NO: 233 or an amino acid sequence that is at least 95% identical to the amino acid sequence of SEQ ID NO: 233; or (ee) first polypeptide chain comprises the amino acid sequence of SEQ ID NO: 243 or an amino acid sequence that is at least 95% identical to the amino acid sequence of SEQ ID NO: 243; the second polypeptide chain comprises the amino acid sequence of SEQ ID NO: 242 or an amino acid sequence that is at least 95% identical to the amino acid sequence of SEQ ID NO: 242; the third polypeptide chain comprises the amino acid sequence of SEQ ID NO: 240 or an amino acid sequence that is at least 95% identical to the amino acid sequence of SEQ ID NO: 240; and the fourth polypeptide chain comprises the amino acid sequence of SEQ ID NO: 241 or an amino acid sequence that is at least 95% identical to the amino acid sequence of SEQ ID NO: 241.

Item 60: A binding protein comprising four polypeptide chains that form three antigen binding sites that specifically bind one or more HIV target proteins and one or more T cell target proteins, wherein a first polypeptide chain comprises a structure represented by the formula:

$$V_{L2}\text{-}L_1\text{-}V_{L1}\text{-}L_2\text{-}C_L \quad [I];$$

a second polypeptide chain comprises a structure represented by the formula:

$$V_{H1}\text{-}L_3\text{-}V_{H2}\text{-}L_4\text{-}C_{H1} \quad [II];$$

a third polypeptide chain comprises a structure represented by the formula:

$$V_{H3}\text{-}C_{H1} \quad [III];$$

and a fourth polypeptide chain comprises a structure represented by the formula:

$$V_{L3}\text{-}C_L \quad [IV];$$

wherein $V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$, and $L_4$ are amino acid linkers;

and wherein the polypeptide of formula I and the polypeptide of formula II form a cross-over light chain-heavy chain pair.

Item 61: A binding protein comprising four polypeptide chains that form three antigen binding sites that specifically bind one or more HIV target proteins and one or more T cell target proteins, wherein a first polypeptide chain comprises a structure represented by the formula:

$$V_{L2}\text{-}L_1\text{-}V_{L1}\text{-}L_2\text{-}C_L \quad [I];$$

a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II];$$

a third polypeptide chain comprises a structure represented by the formula:

$$V_{H3}\text{-}C_{H1}\text{-hinge-}C_{H2}\text{-}C_{H3} \quad [III];$$

and a fourth polypeptide chain comprises a structure represented by the formula:

$$V_{L3}\text{-}C_L \quad [IV];$$

wherein $V_{L1}$ is a first immunoglobulin light chain variable domain;
$V_{L2}$ is a second immunoglobulin light chain variable domain;
$V_{L3}$ is a third immunoglobulin light chain variable domain;

$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain;
$C_{H2}$ is an immunoglobulin $C_{H2}$ heavy chain constant domain;
$C_{H3}$ is an immunoglobulin $C_{H3}$ heavy chain constant domain;
hinge is an immunoglobulin hinge region connecting the $C_{H1}$ and $C_{H2}$ domains; and
$L_1$, $L_2$, $L_3$, and $L_4$ are amino acid linkers;
and wherein the polypeptide of formula I and the polypeptide of formula II form a cross-over light chain-heavy chain pair.

Item 62: The binding protein of item 60 or item 61, wherein the one or more HIV target proteins are selected from the group consisting of glycoprotein 120, glycoprotein 41 and glycoprotein 160.

Item 63: The binding protein of item 60 or item 61, wherein the one or more T cell target proteins are CD3 or CD28.

Item 64: The binding protein of item 60 or item 61, wherein the binding protein is trispecific and capable of specifically binding an HIV target protein and two different epitopes on a single T cell target protein.

Item 65: The binding protein of item 60 or item 61, wherein the binding protein is trispecific and capable of specifically binding an HIV target protein and two different T cell target proteins.

Item 66: The binding protein of item 60 or item 61, wherein the binding protein is trispecific and capable of specifically binding a T cell target protein and two different epitopes on a single HIV target protein.

Item 67: The binding protein of item 60 or item 61, wherein the binding protein is trispecific and capable of specifically binding a T cell target protein and two different HIV target proteins.

Item 68: The binding protein of item 60 or item 61, wherein the first and second polypeptide chains form two antigen binding sites that specifically target two T cell target proteins, and the third and fourth polypeptide chains form an antigen binding site that specifically binds an HIV target protein.

Item 69: The binding protein of any one of items 60-68, wherein $V_{L1}$ comprises a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; a sequence as set forth in SEQ ID NOs: 278, 279, and 280, respectively; a sequence as set forth in SEQ ID NOs: 488, 489, and 490, respectively; a sequence as set forth in SEQ ID NOs: 491, 492, and 493, respectively; or a sequence as set forth in SEQ ID NOs: 494, 495, and 496, respectively.

Item 70: The binding protein of any one of items 60-68, wherein $V_{L1}$ comprises a CDR-L1, CDR-L2, and CDR-L3 of a light chain variable domain comprising a sequence selected from the group consisting of SEQ ID NOs: 512, 513, 514, 515, 516, 517, 518, 519, 520, 521, 522, 523, and 524.

Item 71: The binding protein of any one of items 60-70, wherein $V_{L1}$ comprises a light chain variable domain comprising a sequence selected from the group consisting of SEQ ID NOs: 512, 513, 514, 515, 516, 517, 518, 519, 520, 521, 522, 523, and 524.

Item 72: The binding protein of any one of items 60-71, wherein $V_{L2}$ comprises a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; a sequence as set forth in SEQ ID NOs: 278, 279, and 280, respectively; a sequence as set forth in SEQ ID NOs: 488, 489, and 490, respectively; a sequence as set forth in SEQ ID NOs: 491, 492, and 493, respectively; or a sequence as set forth in SEQ ID NOs: 494, 495, and 496, respectively.

Item 73: The binding protein of any one of items 60-71, wherein $V_{L2}$ comprises a CDR-L1, CDR-L2, and CDR-L3 of a light chain variable domain comprising a sequence selected from the group consisting of SEQ ID NOs: 512, 513, 514, 515, 516, 517, 518, 519, 520, 521, 522, 523, and 524.

Item 74: The binding protein of any one of items 60-73, wherein $V_{L2}$ comprises a light chain variable domain comprising a sequence selected from the group consisting of SEQ ID NOs: 512, 513, 514, 515, 516, 517, 518, 519, 520, 521, 522, 523, and 524.

Item 75: The binding protein of any one of items 60-74, wherein $V_{L3}$ comprises a CDR-L1, CDR-L2, and CDR-L3 comprising a sequence as set forth in SEQ ID NOs: 266, 267, and 268, respectively; a sequence as set forth in SEQ ID NOs: 269, 270, and 271, respectively; a sequence as set forth in SEQ ID NOs: 500, 501, and 274, respectively; a sequence as set forth in SEQ ID NOs: 275, 276, and 277, respectively; a sequence as set forth in SEQ ID NOs: 281, 282, and 283, respectively; a sequence as set forth in SEQ ID NOs: 278, 279, and 280, respectively; a sequence as set forth in SEQ ID NOs: 488, 489, and 490, respectively; a sequence as set forth in SEQ ID NOs: 491, 492, and 493, respectively; or a sequence as set forth in SEQ ID NOs: 494, 495, and 496, respectively.

Item 76: The binding protein of any one of items 60-74, wherein $V_{L3}$ comprises a CDR-L1, CDR-L2, and CDR-L3 of a light chain variable domain comprising a sequence selected from the group consisting of SEQ ID NOs: 512, 513, 514, 515, 516, 517, 518, 519, 520, 521, 522, 523, and 524.

Item 77: The binding protein of any one of items 60-76, wherein $V_{L3}$ comprises a light chain variable domain comprising a sequence selected from the group consisting of SEQ ID NOs: 512, 513, 514, 515, 516, 517, 518, 519, 520, 521, 522, 523, and 524.

Item 78: The binding protein of any one of items 60-77, wherein $V_{H1}$ comprises a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; a sequence as set forth in SEQ ID NOs: 499, 261, and 262, respectively; a sequence as set forth in SEQ ID NOs: 479, 480, and 481, respectively; a sequence as set forth in SEQ ID NOs: 482, 483, and 484, respectively; or a sequence as set forth in SEQ ID NOs: 485, 486, and 487, respectively.

Item 79: The binding protein of any one of items 60-77, wherein $V_{H1}$ comprises a CDR-H1, CDR-H2, and CDR-H3 of a heavy chain variable domain comprising a sequence selected from the group consisting of SEQ ID NOs: 502, 503, 504, 505, 506, 507, 508, 509, 510, and 511.

Item 80: The binding protein of any one of items 60-79, wherein $V_{H1}$ comprises a heavy chain variable domain comprising a sequence selected from the group consisting of SEQ ID NOs: 502, 503, 504, 505, 506, 507, 508, 509, 510, and 511.

Item 81: The binding protein of any one of items 60-80, wherein $V_{H2}$ comprises a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; a sequence as set forth in SEQ ID NOs: 499, 261, and 262, respectively; a sequence as set forth in SEQ ID NOs: 479, 480, and 481, respectively; a sequence as set forth in SEQ ID NOs: 482, 483, and 484, respectively; or a sequence as set forth in SEQ ID NOs: 485, 486, and 487, respectively.

Item 82: The binding protein of any one of items 60-80, wherein $V_{H2}$ comprises a CDR-H1, CDR-H2, and CDR-H3 of a heavy chain variable domain comprising a sequence selected from the group consisting of SEQ ID NOs: 502, 503, 504, 505, 506, 507, 508, 509, 510, and 511.

Item 83: The binding protein of any one of items 60-82, wherein $V_{H2}$ comprises a heavy chain variable domain comprising a sequence selected from the group consisting of SEQ ID NOs: 502, 503, 504, 505, 506, 507, 508, 509, 510, and 511.

Item 84: The binding protein of any one of items 60-83, wherein $V_{H3}$ comprises a CDR-H1, CDR-H2, and CDR-H3 comprising a sequence as set forth in SEQ ID NOs: 248, 497, and 250, respectively; a sequence as set forth in SEQ ID NOs: 251, 252, and 253, respectively; a sequence as set forth in SEQ ID NOs: 254, 255, and 256, respectively; a sequence as set forth in SEQ ID NOs: 254, 255, and 498, respectively; a sequence as set forth in SEQ ID NOs: 257, 258, and 259, respectively; a sequence as set forth in SEQ ID NOs: 263, 264, and 265, respectively; a sequence as set forth in SEQ ID NOs: 499, 261, and 262, respectively; a sequence as set forth in SEQ ID NOs: 479, 480, and 481, respectively; a sequence as set forth in SEQ ID NOs: 482, 483, and 484, respectively; or a sequence as set forth in SEQ ID NOs: 485, 486, and 487, respectively.

Item 85: The binding protein of any one of items 60-83, wherein $V_{H3}$ comprises a CDR-H1, CDR-H2, and CDR-H3 of a heavy chain variable domain comprising a sequence selected from the group consisting of SEQ ID NOs: 502, 503, 504, 505, 506, 507, 508, 509, 510, and 511.

Item 86: The binding protein of any one of items 60-85, wherein $V_{H3}$ comprises a heavy chain variable domain comprising a sequence selected from the group consisting of SEQ ID NOs: 502, 503, 504, 505, 506, 507, 508, 509, 510, and 511.

Item 87: The binding protein of any one of items 60-86, wherein $V_{L1}$ comprises a CDR-L1 comprising the sequence of SEQ ID NO: 488, a CDR-L2 comprising the sequence of SEQ ID NO: 489, and a CDR-L3 comprising the sequence of SEQ ID NO: 490; $V_{L2}$ comprises a CDR-L1 comprising the sequence of SEQ ID NO: 494, a CDR-L2 comprising the sequence of SEQ ID NO: 495, and a CDR-L3 comprising the sequence of SEQ ID NO: 496; $V_{L3}$ comprises a CDR-L1 comprising the sequence of SEQ ID NO: 269, a CDR-L2 comprising the sequence of SEQ ID NO: 270, and a CDR-L3 comprising the sequence of SEQ ID NO: 271; $V_{H1}$ comprises a CDR-H1 comprising the sequence of SEQ ID NO: 479, a CDR-H2 comprising the sequence of SEQ ID NO: 480, and a CDR-H3 comprising the sequence of SEQ ID NO: 481; $V_{H2}$ comprises a CDR-H1 comprising the sequence of SEQ ID NO: 485, a CDR-H2 comprising the sequence of SEQ ID NO: 486, and a CDR-H3 comprising the sequence of SEQ ID NO: 487; and $V_{H3}$ comprises a CDR-H1 comprising the sequence of SEQ ID NO: 251, a CDR-H2 comprising the sequence of SEQ ID NO: 252, and a CDR-H3 comprising the sequence of SEQ ID NO: 253.

Item 88: The binding protein of any one of items 60-86, wherein $V_{L1}$ comprises a CDR-L1, CDR-L2, and CDR-L3 of a light chain variable domain comprising the light chain variable domain sequence of SEQ ID NO: 522; $V_{L2}$ comprises a CDR-L1, CDR-L2, and CDR-L3 of a light chain variable domain comprising the light chain variable domain sequence of SEQ ID NO: 524; $V_{L3}$ comprises a CDR-L1, CDR-L2, and CDR-L3 of a light chain variable domain comprising the light chain variable domain sequence of SEQ ID NO: 513; $V_{H1}$ comprises a CDR-H1, CDR-H2, and CDR-H3 of a heavy chain variable domain comprising the heavy chain variable domain sequence of SEQ ID NO: 509; $V_{H2}$ comprises a CDR-H1, CDR-H2, and CDR-H3 of a heavy chain variable domain comprising the heavy chain variable domain sequence of SEQ ID NO: 511; and $V_{H3}$ comprises a CDR-H1, CDR-H2, and CDR-H3 of a heavy chain variable domain comprising the heavy chain variable domain sequence of SEQ ID NO: 503.

Item 89: The binding protein of any one of items 60-88, wherein $V_{L1}$ comprises a light chain variable domain comprising the sequence of SEQ ID NO: 522; $V_{L2}$ comprises a light chain variable domain comprising the sequence of SEQ ID NO: 524; $V_{L3}$ comprises a light chain variable domain comprising the sequence of SEQ ID NO: 513; $V_{H1}$ comprises a heavy chain variable domain comprising the sequence of SEQ ID NO: 509; $V_{H2}$ comprises a heavy chain variable domain comprising the sequence of SEQ ID NO: 511; and $V_{H3}$ comprises a heavy chain variable domain comprising the sequence of SEQ ID NO: 503.

Item 90: The binding protein of any one of items 60-86, wherein $V_{L1}$ comprises a CDR-L1 comprising the sequence of SEQ ID NO: 494, a CDR-L2 comprising the sequence of SEQ ID NO: 495, and a CDR-L3 comprising the sequence of SEQ ID NO: 496; $V_{L2}$ comprises a CDR-L1 comprising the sequence of SEQ ID NO: 488, a CDR-L2 comprising the sequence of SEQ ID NO: 489, and a CDR-L3 comprising the sequence of SEQ ID NO: 490; $V_{L3}$ comprises a CDR-L1 comprising the sequence of SEQ ID NO: 269, a CDR-L2 comprising the sequence of SEQ ID NO: 270, and a CDR-L3 comprising the sequence of SEQ ID NO: 271; $V_{H1}$ comprises a CDR-H1 comprising the sequence of SEQ ID NO: 485, a CDR-H2 comprising the sequence of SEQ ID NO: 486, and a CDR-H3 comprising the sequence of SEQ ID NO: 487; $V_{H2}$ comprises a CDR-H1 comprising the sequence of SEQ ID NO: 479, a CDR-H2 comprising the sequence of SEQ ID NO: 480, and a CDR-H3 comprising the sequence of SEQ ID NO: 481; and $V_{H3}$ comprises a CDR-H1 comprising the sequence of SEQ ID NO: 251, a CDR-H2 comprising the sequence of SEQ ID NO: 252, and a CDR-H3 comprising the sequence of SEQ ID NO: 253.

Item 91: The binding protein of any one of items 60-86, wherein $V_{L1}$ comprises a CDR-L1, CDR-L2, and CDR-L3 of a light chain variable domain comprising the light chain variable domain sequence of SEQ ID NO: 524; $V_{L2}$ comprises a CDR-L1, CDR-L2, and CDR-L3 of a light chain variable domain comprising the light chain variable domain sequence of SEQ ID NO: 522; $V_{L3}$ comprises a CDR-L1, CDR-L2, and CDR-L3 of a light chain variable domain comprising the light chain variable domain sequence of SEQ ID NO: 513; $V_{H1}$ comprises a CDR-H1, CDR-H2, and CDR-H3 of a heavy chain variable domain comprising the heavy chain variable domain sequence of SEQ ID NO: 511; $V_{H2}$ comprises a CDR-H1, CDR-H2, and CDR-H3 of a heavy chain variable domain comprising the heavy chain variable domain sequence of SEQ ID NO: 509; and $V_{H3}$ comprises a CDR-H1, CDR-H2, and CDR-H3 of a heavy chain variable domain comprising the heavy chain variable domain sequence of SEQ ID NO: 503.

Item 92: The binding protein of any one of items 60-86 and 90-91, wherein $V_{L1}$ comprises a light chain variable domain comprising the sequence of SEQ ID NO: 524; $V_{L2}$ comprises a light chain variable domain comprising the sequence of SEQ ID NO: 522; $V_{L3}$ comprises a light chain variable domain comprising the sequence of SEQ ID NO: 513; $V_{H1}$ comprises a heavy chain variable domain comprising the sequence of SEQ ID NO: 511; $V_{H2}$ comprises a heavy chain variable domain comprising the sequence of SEQ ID NO: 509; and $V_{H3}$ comprises a heavy chain variable domain comprising the sequence of SEQ ID NO: 503.

Item 93: The binding protein of item 60, wherein the second polypeptide chain further comprises an Fc region linked to $C_{H1}$, the Fc region comprising an immunoglobulin hinge region and $C_{H2}$ and $C_{H3}$ immunoglobulin heavy chain constant domains.

Item 94: The binding protein of item 60, wherein the third polypeptide chain further comprises an Fc region linked to $C_{H1}$, the Fc region comprising an immunoglobulin hinge region and $C_{H2}$ and $C_{H3}$ immunoglobulin heavy chain constant domains.

Item 95: The binding protein of item 60, wherein the second polypeptide chain further comprises a first Fc region linked to CHI, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 354 and 366 of human IgG1 according to EU Index, wherein the amino acid substitutions are S354C and T366W; and wherein the third polypeptide chain further comprises a second Fc region linked to CHI, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 349, 366, 368, and 407 of human IgG1 according to EU Index, wherein the amino acid substitutions are Y349C, T366S, L368A, and Y407V.

Item 96: The binding protein of item 60, wherein the second polypeptide chain further comprises a first Fc region linked to CHI, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 349, 366, 368, and 407 of human IgG1 according to EU Index, wherein the amino acid substitutions are Y349C, T366S, L368A, and Y407V; and wherein the third polypeptide chain further comprises a second Fc region linked to CHI, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 354 and 366 of human IgG1 according to EU Index, wherein the amino acid substitutions are S354C and T366W.

Item 97: The binding protein of any one of items 60, 95, and 96, wherein the second polypeptide chain further comprises a first Fc region linked to CHI, the first Fc region comprising an immunoglobulin hinge region and $C_{H2}$ and $C_{H3}$ immunoglobulin heavy chain constant domains, and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains; wherein the first and second Fc regions comprise amino acid substitutions at positions corresponding to positions 428 and 434 of human IgG1 according to EU Index, wherein the amino acid substitutions are M428L and N434S.

Item 98: The binding protein of item 61, wherein the $C_{H3}$ domain of the second polypeptide chain comprises amino acid substitutions at positions corresponding to positions 354 and 366 of human IgG1 according to EU Index, wherein the amino acid substitutions are S354C and T366W; and wherein the $C_{H3}$ domain of the third polypeptide chain comprises amino acid substitutions at positions corresponding to positions 349, 366, 368, and 407 of human IgG1 according to EU Index, wherein the amino acid substitutions are Y349C, T366S, L368A, and Y407V.

Item 99: The binding protein of item 61, wherein the $C_{H3}$ domain of the second polypeptide chain comprises amino acid substitutions at positions corresponding to positions 349, 366, 368, and 407 of human IgG1 according to EU Index, wherein the amino acid substitutions are Y349C, T366S, L368A, and Y407V; and wherein the $C_{H3}$ domain of the third polypeptide chain comprises amino acid substitutions at positions corresponding to positions 354 and 366 of human IgG1 according to EU Index, wherein the amino acid substitutions are S354C and T366W.

Item 100: The binding protein of any one of items 61, 98, and 99, wherein the $C_{H3}$ domains of the second and the third polypeptide chains both comprise amino acid substitutions at positions corresponding to positions 428 and 434 of human IgG1 according to EU Index, wherein the amino acid substitutions are M428L and N434S.

Item 101: The binding protein of item 60 or item 61, wherein at least one of $L_1$, $L_2$, $L_3$, or $L_4$ is independently 0 amino acids in length.

Item 102: The binding protein of item 60 or item 61, wherein $L_1$, $L_2$, $L_3$, or $L_4$ are each independently at least one amino acid in length.

Item 103: The binding protein of any one of items 60-102, wherein $L_1$ is Gly-Gln-Pro-Lys-Ala-Ala-Pro (SEQ ID NO: 299).

Item 104: A binding protein comprising four polypeptide chains that form three antigen binding sites, wherein a first polypeptide chain comprises a structure represented by the formula:

$$V_{L2}\text{-}L_1\text{-}V_{L1}\text{-}L_2\text{-}C_L \qquad [\text{I}]$$

and a second polypeptide chain comprises a structure represented by the formula:

$$V_{H1}\text{-}L_3\text{-}V_{H2}\text{-}L_4\text{-}C_{H1} \qquad [\text{II}]$$

and a third polypeptide chain comprises a structure represented by the formula:

$$V_{H3}\text{-}C_{H1} \qquad [\text{III}]$$

and a fourth polypeptide chain comprises a structure represented by the formula:

$$V_{L3}\text{-}C_L \quad [IV]$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain; and
$L_1$, $L_2$, $L_3$, and $L_4$ are amino acid linkers;
wherein the polypeptide of formula I and the polypeptide of formula II form a cross-over light chain-heavy chain pair;
wherein:
(a) $V_{L1}$, $V_{L2}$ and $V_{L3}$ are each independently a variable domain derived from an amino acid sequence as set forth in any one of SEQ ID NOs: 303, 305, 311, 313, 319, 321, 327, 329, 335, 337, 343, 345, 351, 353, 359, 361, 367, 369, 375, 377, 383, 385, 391, 393, 399, 401, 407, 409, 415, 417, 423, 425, 431, 433, 439, 441, 447, 449, 455, 457, 463, 465, 471, 473; or
(b) $V_{L1}$, $V_{L2}$ and $V_{L3}$ each independently comprise light chain complementarity determining regions of a variable domain comprising an amino acid sequence as set forth in any one of SEQ ID NOs: 266-271, 275-277, 488-496; and
wherein:
(a) $V_{H1}$, $V_{H2}$, and $V_{H3}$ are each independently a variable domain derived from an amino acid sequence as set forth in any one of SEQ ID NOs: 302, 304, 310, 312, 318, 320, 326, 328, 334, 336, 342, 344, 350, 352, 358, 360, 366, 368, 374, 376, 382, 384, 390, 392, 398, 400, 406, 408, 414, 416, 422, 424, 430, 432, 438, 440, 446, 448, 454, 456, 462, 464, 470, 472; or
(b) $V_{H1}$, $V_{H2}$, and $V_{H3}$ each independently comprise heavy chain complementarity determining regions of a variable domain comprising an amino acid sequence as set forth in any one of SEQ ID NOs: 248-253, 257-259, 479-487.

Item 105: A binding protein comprising four polypeptide chains that form three antigen binding sites, wherein a first polypeptide chain comprises a structure represented by the formula:

$$V_{L2}\text{-}L_1\text{-}V_{L1}\text{-}L_2\text{-}C_L \quad [I]$$

and a second polypeptide chain comprises a structure represented by the formula:

$$V_{H1}\text{-}L_3\text{-}V_{H2}\text{-}L_4\text{-}C_{H1}\text{-hinge-}C_{H2}\text{-}C_{H3} \quad [II]$$

and a third polypeptide chain comprises a structure represented by the formula:

$$V_{H3}\text{-}C_{H1}\text{-hinge-}C_{H2}\text{-}C_{H3} \quad [III]$$

and a fourth polypeptide chain comprises a structure represented by the formula:

$$V_{L3}\text{-}C_L \quad [IV]$$

wherein:
$V_{L1}$ is a first immunoglobulin light chain variable domain;
$V_{L2}$ is a second immunoglobulin light chain variable domain;
$V_{L3}$ is a third immunoglobulin light chain variable domain;
$V_{H1}$ is a first immunoglobulin heavy chain variable domain;
$V_{H2}$ is a second immunoglobulin heavy chain variable domain;
$V_{H3}$ is a third immunoglobulin heavy chain variable domain;
$C_L$ is an immunoglobulin light chain constant domain;
$C_{H1}$ is the immunoglobulin $C_{H1}$ heavy chain constant domain;
$C_{H2}$ is an immunoglobulin $C_{H2}$ heavy chain constant domain;
$C_{H3}$ is an immunoglobulin $C_{H3}$ heavy chain constant domain;
hinge is an immunoglobulin hinge region connecting the $C_{H1}$ and $C_{H2}$ domains; and
$L_1$, $L_2$, $L_3$, and $L_4$ are amino acid linkers;
wherein the polypeptide of formula I and the polypeptide of formula II form a cross-over light chain-heavy chain pair;
wherein:
(a) $V_{L1}$, $V_{L2}$ and $V_{L3}$ are each independently a variable domain derived from an amino acid sequence as set forth in any one of SEQ ID NOs: 303, 305, 311, 313, 319, 321, 327, 329, 335, 337, 343, 345, 351, 353, 359, 361, 367, 369, 375, 377, 383, 385, 391, 393, 399, 401, 407, 409, 415, 417, 423, 425, 431, 433, 439, 441, 447, 449, 455, 457, 463, 465, 471, 473; or
(b) $V_{L1}$, $V_{L2}$ and $V_{L3}$ each independently comprise light chain complementarity determining regions of a variable domain comprising an amino acid sequence as set forth in any one of SEQ ID NOs: 266-271, 275-277, 488-496; and
wherein:
(a) $V_{H1}$, $V_{H2}$, and $V_{H3}$ are each independently a variable domain derived from an amino acid sequence as set forth in any one of SEQ ID NOs: 302, 304, 310, 312, 318, 320, 326, 328, 334, 336, 342, 344, 350, 352, 358, 360, 366, 368, 374, 376, 382, 384, 390, 392, 398, 400, 406, 408, 414, 416, 422, 424, 430, 432, 438, 440, 446, 448, 454, 456, 462, 464, 470, 472; or
(b) $V_{H1}$, $V_{H2}$, and $V_{H3}$ each independently comprise heavy chain complementarity determining regions of a variable domain comprising an amino acid sequence as set forth in any one of SEQ ID NOs: 248-253, 257-259, 479-487.

Item 106: The binding protein of item 104, wherein the second polypeptide chain further comprises an Fc region linked to $C_{H1}$, the Fc region comprising an immunoglobulin hinge region and $C_{H2}$ and $C_{H3}$ immunoglobulin heavy chain constant domains.

Item 107: The binding protein of item 104, wherein the third polypeptide chain further comprises an Fc region linked to $C_{H1}$, the Fc region comprising an immunoglobulin hinge region and $C_{H2}$ and $C_{H3}$ immunoglobulin heavy chain constant domains.

Item 108: The binding protein of item 104, wherein the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 354 and 366 of human IgG1 according to EU Index, wherein the amino acid substitutions are S354C and T366W; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 349, 366, 368, and 407 of human IgG1 according to EU Index, wherein the amino acid substitutions are Y349C, T366S, L368A, and Y407V.

Item 109: The binding protein of item 104, wherein the second polypeptide chain further comprises a first Fc region linked to $C_{H1}$, the first Fc region comprising an immunoglobulin hinge region and $C_{H2}$ and $C_{H3}$ immunoglobulin heavy chain constant domains, wherein the first Fc region comprises amino acid substitutions at positions corresponding to positions 349, 366, 368, and 407 of human IgG1 according to EU Index, wherein the amino acid substitutions are Y349C, T366S, L368A, and Y407V; and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains, wherein the second Fc region comprises amino acid substitutions at positions corresponding to positions 354 and 366 of human IgG1 according to EU Index, wherein the amino acid substitutions are S354C and T366W.

Item 110: The binding protein of any one of items 104, 108, and 109, wherein the second polypeptide chain further comprises a first Fc region linked to $C_{H1}$, the first Fc region comprising an immunoglobulin hinge region and $C_{H2}$ and $C_{H3}$ immunoglobulin heavy chain constant domains, and wherein the third polypeptide chain further comprises a second Fc region linked to $C_{H1}$, the second Fc region comprising an immunoglobulin hinge region and $C_{H2}$ and $C_{H3}$ immunoglobulin heavy chain constant domains; wherein the first and second Fc regions comprise amino acid substitutions at positions corresponding to positions 428 and 434 of human IgG1 according to EU Index, wherein the amino acid substitutions are M428L and N434S.

Item 111: The binding protein of item 105, wherein the $C_{H3}$ domain of the second polypeptide chain comprises amino acid substitutions at positions corresponding to positions 354 and 366 of human IgG1 according to EU Index, wherein the amino acid substitutions are S354C and T366W; and wherein the $C_{H3}$ domain of the third polypeptide chain comprises amino acid substitutions at positions corresponding to positions 349, 366, 368, and 407 of human IgG1 according to EU Index, wherein the amino acid substitutions are Y349C, T366S, L368A, and Y407V.

Item 112: The binding protein of item 105, wherein the $C_{H3}$ domain of the second polypeptide chain comprises amino acid substitutions at positions corresponding to positions 349, 366, 368, and 407 of human IgG1 according to EU Index, wherein the amino acid substitutions are Y349C, T366S, L368A, and Y407V; and wherein the $C_{H3}$ domain of the third polypeptide chain comprises amino acid substitutions at positions corresponding to positions 354 and 366 of human IgG1 according to EU Index, wherein the amino acid substitutions are S354C and T366W.

Item 113: The binding protein of any one of items 105, 111, and 112, wherein the $C_{H3}$ domains of the second and the third polypeptide chains both comprise amino acid substitutions at positions corresponding to positions 428 and 434 of human IgG1 according to EU Index, wherein the amino acid substitutions are M428L and N434S.

Item 114: The binding protein of item 104 or item 105, wherein at least one of $L_1$, $L_2$, $L_3$, or $L_4$ is independently 0 amino acids in length.

Item 115: The binding protein of item 104 or item 105, wherein $L_1$, $L_2$, $L_3$, or $L_4$ are each independently at least one amino acid in length.

Item 116: The binding protein of any one of items 104-115, wherein $L_1$ is Gly-Gln-Pro-Lys-Ala-Ala-Pro (SEQ ID NO: 299).

Item 117: A binding protein comprising a first polypeptide chain, a second polypeptide chain, a third polypeptide chain and a fourth polypeptide chain wherein:

(a) the first polypeptide chain comprises the amino acid sequence of SEQ ID NO: 305 or an amino acid sequence that is at least 95% identical to the amino acid sequence of SEQ ID NO: 305; the second polypeptide chain comprises the amino acid sequence of SEQ ID NO: 304 or an amino acid sequence that is at least 95% identical to the amino acid sequence of SEQ ID NO: 304; the third polypeptide chain comprises the amino acid sequence of SEQ ID NO: 302 or an amino acid sequence that is at least 95% identical to the amino acid sequence of SEQ ID NO: 302; and the fourth polypeptide chain comprises the amino acid sequence of SEQ ID NO: 303 or an amino acid sequence that is at least 95% identical to the amino acid sequence of SEQ ID NO: 303;

(b) the first polypeptide chain comprises the amino acid sequence of SEQ ID NO: 313 or an amino acid sequence that is at least 95% identical to the amino acid sequence of SEQ ID NO: 313; the second polypeptide chain comprises the amino acid sequence of SEQ ID NO: 312 or an amino acid sequence that is at least 95% identical to the amino acid sequence of SEQ ID NO: 312; the third polypeptide chain comprises the amino acid sequence of SEQ ID NO: 310 or an amino acid sequence that is at least 95% identical to the amino acid sequence of SEQ ID NO: 310; and the fourth polypeptide chain comprises the amino acid sequence of SEQ ID NO: 311 or an amino acid sequence that is at least 95% identical to the amino acid sequence of SEQ ID NO: 311;

(c) the first polypeptide chain comprises the amino acid sequence of SEQ ID NO: 321 or an amino acid sequence that is at least 95% identical to the amino acid sequence of SEQ ID NO: 321; the second polypeptide chain comprises the amino acid sequence of SEQ ID NO: 320 or an amino acid sequence that is at least 95% identical to the amino acid sequence of SEQ ID NO: 320; the third polypeptide chain comprises the amino acid sequence of SEQ ID NO: 318 or an amino acid sequence that is at least 95% identical to the amino acid sequence of SEQ ID NO: 318; and the fourth polypeptide chain comprises the amino acid sequence of SEQ ID NO: 319 or an amino acid sequence that is at least 95% identical to the amino acid sequence of SEQ ID NO: 319;

(d) the first polypeptide chain comprises the amino acid sequence of SEQ ID NO: 329 or an amino acid sequence that is at least 95% identical to the amino acid sequence of SEQ ID NO: 329; the second polypeptide chain comprises the amino acid sequence of SEQ ID NO: 328 or an amino acid sequence that is at least 95% identical to the amino acid sequence of SEQ ID NO: 328; the third polypeptide chain comprises the amino acid sequence of SEQ ID NO: 326 or an amino acid sequence that is at least 95% identical to the amino acid sequence of SEQ ID NO: 326; and the fourth polypeptide chain comprises the amino acid sequence of SEQ ID NO: 327 or an amino acid sequence that is at least 95% identical to the amino acid sequence of SEQ ID NO: 327;

(e) the first polypeptide chain comprises the amino acid sequence of SEQ ID NO: 337 or an amino acid sequence that is at least 95% identical to the amino acid sequence of SEQ ID NO: 337; the second polypeptide chain comprises the amino acid sequence of SEQ ID NO: 336 or an amino acid sequence that is at least 95% identical to the amino acid sequence of SEQ ID NO: 336; the third polypeptide chain comprises the amino acid sequence of SEQ ID NO: 334 or an amino acid sequence that is at least 95% identical to the amino acid sequence of SEQ ID NO: 334; and the fourth polypeptide chain comprises the amino acid sequence of SEQ ID NO: 335 or an amino acid sequence that is at least 95% identical to the amino acid sequence of SEQ ID NO: 335;

(f) the first polypeptide chain comprises the amino acid sequence of SEQ ID NO: 345 or an amino acid sequence that is at least 95% identical to the amino acid sequence of SEQ ID NO: 345; the second polypeptide chain comprises the amino acid sequence of SEQ ID NO: 344 or an amino acid sequence that is at least 95% identical to the amino acid sequence of SEQ ID NO: 344; the third polypeptide chain comprises the amino acid sequence of SEQ ID NO: 342 or an amino acid sequence that is at least 95% identical to the amino acid sequence of SEQ ID NO: 342; and the fourth polypeptide chain comprises the amino acid sequence of SEQ ID NO: 343 or an amino acid sequence that is at least 95% identical to the amino acid sequence of SEQ ID NO: 343;

(g) the first polypeptide chain comprises the amino acid sequence of SEQ ID NO: 353 or an amino acid sequence that is at least 95% identical to the amino acid sequence of SEQ ID NO: 353; the second polypeptide chain comprises the amino acid sequence of SEQ ID NO: 352 or an amino acid sequence that is at least 95% identical to the amino acid sequence of SEQ ID NO:352; the third polypeptide chain comprises the amino acid sequence of SEQ ID NO: 350 or an amino acid sequence that is at least 95% identical to the amino acid sequence of SEQ ID NO: 350; and the fourth polypeptide chain comprises the amino acid sequence of SEQ ID NO: 351 or an amino acid sequence that is at least 95% identical to the amino acid sequence of SEQ ID NO: 351;

(h) the first polypeptide chain comprises the amino acid sequence of SEQ ID NO: 361 or an amino acid sequence that is at least 95% identical to the amino acid sequence of SEQ ID NO: 361; the second polypeptide chain comprises the amino acid sequence of SEQ ID NO: 360 or an amino acid sequence that is at least 95% identical to the amino acid sequence of SEQ ID NO: 360; the third polypeptide chain comprises the amino acid sequence of SEQ ID NO: 358 or an amino acid sequence that is at least 95% identical to the amino acid sequence of SEQ ID NO: 358; and the fourth polypeptide chain comprises the amino acid sequence of SEQ ID NO: 359 or an amino acid sequence that is at least 95% identical to the amino acid sequence of SEQ ID NO: 359;

(i) the first polypeptide chain comprises the amino acid sequence of SEQ ID NO: 369 or an amino acid sequence that is at least 95% identical to the amino acid sequence of SEQ ID NO: 369; the second polypeptide chain comprises the amino acid sequence of SEQ ID NO: 368 or an amino acid sequence that is at least 95% identical to the amino acid sequence of SEQ ID NO: 368; the third polypeptide chain comprises the amino acid sequence of SEQ ID NO: 366 or an amino acid sequence that is at least 95% identical to the amino acid sequence of SEQ ID NO: 366; and the fourth polypeptide chain comprises the amino acid sequence of SEQ ID NO: 367 or an amino acid sequence that is at least 95% identical to the amino acid sequence of SEQ ID NO: 367;

(j) the first polypeptide chain comprises the amino acid sequence of SEQ ID NO: 377 or an amino acid sequence that is at least 95% identical to the amino acid sequence of SEQ ID NO: 377; the second polypeptide chain comprises the amino acid sequence of SEQ ID NO: 376 or an amino acid sequence that is at least 95% identical to the amino acid sequence of SEQ ID NO: 376; the third polypeptide chain comprises the amino acid sequence of SEQ ID NO: 374 or an amino acid sequence that is at least 95% identical to the amino acid sequence of SEQ ID NO: 374; and the fourth polypeptide chain comprises the amino acid sequence of SEQ ID NO: 375 or an amino acid sequence that is at least 95% identical to the amino acid sequence of SEQ ID NO: 375;

(k) the first polypeptide chain comprises the amino acid sequence of SEQ ID NO: 385 or an amino acid sequence that is at least 95% identical to the amino acid sequence of SEQ ID NO: 385; the second polypeptide chain comprises the amino acid sequence of SEQ ID NO: 384 or an amino acid sequence that is at least 95% identical to the amino acid sequence of SEQ ID NO: 384; the third polypeptide chain comprises the amino acid sequence of SEQ ID NO: 382 or an amino acid sequence that is at least 95% identical to the amino acid sequence of SEQ ID NO: 382; and the fourth polypeptide chain comprises the amino acid sequence of SEQ ID NO: 383 or an amino acid sequence that is at least 95% identical to the amino acid sequence of SEQ ID NO: 383;

(l) the first polypeptide chain comprises the amino acid sequence of SEQ ID NO: 393 or an amino acid sequence that is at least 95% identical to the amino acid sequence of SEQ ID NO: 393; the second polypeptide chain comprises the amino acid sequence of SEQ ID NO: 392 or an amino acid sequence that is at least 95% identical to the amino acid sequence of SEQ ID NO: 392; the third polypeptide chain comprises the amino acid sequence of SEQ ID NO: 390 or an amino acid sequence that is at least 95% identical to the amino acid sequence of SEQ ID NO: 390; and the fourth polypeptide chain comprises the amino acid sequence of SEQ ID NO: 391 or an amino acid sequence that is at least 95% identical to the amino acid sequence of SEQ ID NO: 391;

(m) the first polypeptide chain comprises the amino acid sequence of SEQ ID NO: 401 or an amino acid sequence that is at least 95% identical to the amino acid sequence of SEQ ID NO: 401; the second polypeptide chain comprises the amino acid sequence of SEQ ID NO: 400 or an amino acid sequence that is at least 95% identical to the amino acid sequence of SEQ ID NO: 400; the third polypeptide chain comprises the amino acid sequence of SEQ ID NO: 398 or an amino acid sequence that is at least 95% identical to the amino acid sequence of SEQ ID NO: 398; and the fourth polypeptide chain comprises the amino acid sequence of SEQ ID NO: 399 or an amino acid sequence that is at least 95% identical to the amino acid sequence of SEQ ID NO: 399;

(n) the first polypeptide chain comprises the amino acid sequence of SEQ ID NO: 409 or an amino acid sequence that is at least 95% identical to the amino acid sequence of SEQ ID NO: 409; the second polypeptide chain comprises the amino acid sequence of SEQ ID NO: 408 or an amino acid sequence that is at least 95% identical to the amino acid sequence of SEQ ID NO: 408; the third polypeptide chain comprises the amino acid sequence of SEQ ID NO: 406 or an amino acid sequence that is at least 95% identical to the amino acid sequence of SEQ ID NO: 406; and the fourth polypeptide chain comprises the amino acid sequence of SEQ ID NO: 407 or an amino acid sequence that is at least 95% identical to the amino acid sequence of SEQ ID NO: 407;

(p) the first polypeptide chain comprises the amino acid sequence of SEQ ID NO: 417 or an amino acid sequence that is at least 95% identical to the amino acid sequence of SEQ ID NO: 417; the second polypeptide chain comprises the amino acid sequence of SEQ ID NO: 416 or an amino acid sequence that is at least 95% identical to the amino acid sequence of SEQ ID NO: 416; the third polypeptide chain comprises the amino acid sequence of SEQ ID NO: 414 or an amino acid sequence that is at least 95% identical to the amino acid sequence of SEQ ID NO: 414; and the fourth polypeptide chain comprises the amino acid sequence of SEQ ID NO: 415 or an amino acid sequence that is at least 95% identical to the amino acid sequence of SEQ ID NO: 415;

(q) the first polypeptide chain comprises the amino acid sequence of SEQ ID NO: 425 or an amino acid sequence that is at least 95% identical to the amino acid sequence of SEQ ID NO: 425; the second polypeptide chain comprises the amino acid sequence of SEQ ID NO: 424 or an amino acid sequence that is at least 95% identical to the amino acid sequence of SEQ ID NO: 424; the third polypeptide chain comprises the amino acid sequence of SEQ ID NO: 422 or an amino acid sequence that is at least 95% identical to the amino acid sequence of SEQ ID NO: 422; and the fourth polypeptide chain comprises the amino acid sequence of SEQ ID NO: 423 or an amino acid sequence that is at least 95% identical to the amino acid sequence of SEQ ID NO: 423;

(r) the first polypeptide chain comprises the amino acid sequence of SEQ ID NO: 433 or an amino acid sequence that is at least 95% identical to the amino acid sequence of SEQ ID NO:433; the second polypeptide chain comprises the amino acid sequence of SEQ ID NO: 432 or an amino acid sequence that is at least 95% identical to the amino acid sequence of SEQ ID NO: 432; the third polypeptide chain comprises the amino acid sequence of SEQ ID NO: 430 or an amino acid sequence that is at least 95% identical to the amino acid sequence of SEQ ID NO: 430; and the fourth polypeptide chain comprises the amino acid sequence of SEQ ID NO: 431 or an amino acid sequence that is at least 95% identical to the amino acid sequence of SEQ ID NO: 431;

(s) the first polypeptide chain comprises the amino acid sequence of SEQ ID NO: 441 or an amino acid sequence that is at least 95% identical to the amino acid sequence of SEQ ID NO: 441; the second polypeptide chain comprises the amino acid sequence of SEQ ID NO: 440 or an amino acid sequence that is at least 95% identical to the amino acid sequence of SEQ ID NO: 440; the third polypeptide chain comprises the amino acid sequence of SEQ ID NO: 438 or an amino acid sequence that is at least 95% identical to the amino acid sequence of SEQ ID NO: 438; and the fourth polypeptide chain comprises the amino acid sequence of SEQ ID NO: 439 or an amino acid sequence that is at least 95% identical to the amino acid sequence of SEQ ID NO: 439;

(t) the first polypeptide chain comprises the amino acid sequence of SEQ ID NO: 449 or an amino acid sequence that is at least 95% identical to the amino acid sequence of SEQ ID NO: 449; the second polypeptide chain comprises the amino acid sequence of SEQ ID NO: 448 or an amino acid sequence that is at least 95% identical to the amino acid sequence of SEQ ID NO: 448; the third polypeptide chain comprises the amino acid sequence of SEQ ID NO: 446 or an amino acid sequence that is at least 95% identical to the amino acid sequence of SEQ ID NO: 446; and the fourth polypeptide chain comprises the amino acid sequence of SEQ ID NO: 447 or an amino acid sequence that is at least 95% identical to the amino acid sequence of SEQ ID NO: 447;

(u) the first polypeptide chain comprises the amino acid sequence of SEQ ID NO: 457 or an amino acid sequence that is at least 95% identical to the amino acid sequence of SEQ ID NO: 457; the second polypeptide chain comprises the amino acid sequence of SEQ ID NO: 456 or an amino acid sequence that is at least 95% identical to the amino acid sequence of SEQ ID NO: 456; the third polypeptide chain comprises the amino acid sequence of SEQ ID NO: 454 or an amino acid sequence that is at least 95% identical to the amino acid sequence of SEQ ID NO: 454; and the fourth polypeptide chain comprises the amino acid sequence of SEQ ID NO: 455 or an amino acid sequence that is at least 95% identical to the amino acid sequence of SEQ ID NO: 455;

(v) the first polypeptide chain comprises the amino acid sequence of SEQ ID NO: 465 or an amino acid sequence that is at least 95% identical to the amino acid sequence of SEQ ID NO: 465; the second polypeptide chain comprises the amino acid sequence of SEQ ID NO: 464 or an amino acid sequence that is at least 95% identical to the amino acid sequence of SEQ ID NO: 464; the third polypeptide chain comprises the amino acid sequence of SEQ ID NO: 462 or an amino acid sequence that is at least 95% identical to the amino acid sequence of SEQ ID NO: 462; and the fourth polypeptide chain comprises the amino acid sequence of SEQ ID NO: 463 or an amino acid sequence that is at least 95% identical to the amino acid sequence of SEQ ID NO: 463; or (w) the first polypeptide chain comprises the amino acid sequence of SEQ ID NO: 473 or an amino acid sequence that is at least 95% identical to the amino acid sequence of SEQ ID NO: 473; the second polypeptide chain comprises the amino acid sequence of SEQ ID NO: 472 or an amino acid sequence that is at least 95% identical to the amino acid sequence of SEQ ID NO: 472; the third polypeptide chain comprises the amino acid sequence of SEQ ID NO: 470 or an amino acid sequence that is at least 95% identical to the amino acid sequence of SEQ ID NO: 470; and the fourth polypeptide chain comprises the amino acid sequence of SEQ ID NO: 471 or an amino acid sequence that is at least 95% identical to the amino acid sequence of SEQ ID NO: 471.

Item 118: An isolated nucleic acid molecule comprising a nucleotide sequence encoding the binding protein of any one of items 1-117.

Item 119: An expression vector comprising the nucleic acid molecule of item 118.

Item 120: An isolated host cell comprising the nucleic acid molecule of item 118.

Item 121: An isolated host cell comprising the expression vector of item 119.

Item 122: The isolated host cell of item 120 or item 121, wherein the host cell is a mammalian cell or an insect cell.

Item 123: A vector system comprising one or more vectors encoding a first, second, third, and fourth polypeptide chain of a binding protein of any one of items 1-117.

Item 124: The vector system of item 123, wherein the vector system comprises a first vector encoding the first polypeptide chain of the binding protein, a second vector encoding the second polypeptide chain of the binding protein, a third vector encoding the third polypeptide chain of the binding protein, and a fourth vector encoding the fourth polypeptide chain of the binding protein.

Item 125: The vector system of item 123, wherein the vector system comprises a first vector encoding the first and second polypeptide chains of the binding protein, and a second vector encoding the third and fourth polypeptide chains of the binding protein.

Item 126: The vector system of any one of items 123-125, wherein the one or more vectors are expression vectors.

Item 127: An isolated host cell comprising the vector system of any one of items 123-126.

Item 128: The isolated host cell of item 127, wherein the host cell is a mammalian cell or an insect cell.

Item 129: A method of producing a binding protein, the method comprising:
a) culturing a host cell of any one of items 120-122 and items 127-128 under conditions such that the host cell expresses the binding protein; and
b) isolating the binding protein from the host cell.

Item 130: A method of preventing and/or treating HIV infection in a patient comprising administering to the patient a therapeutically effective amount of at least one binding protein of any one of items 1-117.

Item 131: The method of item 130, wherein the binding protein is co-administered with standard anti-retroviral therapy.

Item 132: The method of item 130 or item 131, wherein administration of the at least one binding protein results in the neutralization of one or more HIV virions.

Item 133: The method of any one of items 130-132, wherein administration of the at least one binding protein results in the elimination of one or more latently and/or chronically HIV-infected cells in the patient.

Item 134: The method of any one of items 130-133, wherein the patient is a human.

Item 135: The binding protein of any one of items 1-117 for the prevention or treatment of an HIV infection in a patient.

Item 136: The binding protein of item 135, wherein the binding protein is co-administered with standard anti-retroviral therapy.

Item 137: The binding protein of item 135 or item 136, wherein the binding protein causes the neutralization of one or more HIV virions in the patient.

Item 138: The binding protein of any one of items 135-137, wherein the binding protein causes the elimination of one or more latently and/or chronically HIV-infected cells in the patient.

Item 139: The binding protein of any one of items 135-138, wherein the patient is a human.

EXAMPLES

The Examples that follow are illustrative of specific embodiments of the disclosure, and various uses thereof. They are set forth for explanatory purposes only, and should not be construed as limiting the scope of the invention in any way.

Example 1: Production of Trispecific Binding Proteins Targeting the HIV-1 Env Glycoprotein The HIV-1 envelope glycoprotein (Env/gp160) is located on the surface of the virus particle, and is composed of a homo-trimer comprising three non-covalently-linked transmembrane gp41 and gp120 complexes. Env enables viral entry into target cells by the binding of gp120 to HIV's main receptor (CD4) and co-receptor (CCR5 or CXCR4), followed by the induction of viral/cellular membrane fusion facilitated by conformational changes in gp41, resulting in entry of the viral capsid and delivery of the viral genome into the host cell. Additionally, Env is expressed on the surface of infected cells.

Env acts as the only target for neutralizing antibodies on the HIV-1 virion. Binding of neutralizing antibodies to viral Env inhibits viral attachment/entry. Moreover, binding of neutralizing antibodies to HIV-1 infected, Env expressing cells leads to their destruction by Antibody-Dependent Cell-Mediated Cytotoxicity (ADCC) and Complement Dependent Cytotoxicity (CDC), resulting in reduction of the latent viral reservoir. Thus, neutralizing antibodies targeting Env are an attractive area for anti-viral therapy development. However, because of the high sequence diversity and mutation rate of the HIV-1 virus, developing neutralizing antibodies targeting Env has proven challenging due to the high likelihood that a given HIV-1 strain either lacks the epitope of any given neutralizing antibody, or the strain has evolved a mutation to become resistant to the antibody. Strategies must be developed to mitigate the breakthrough of viral strains when developing novel neutralizing antibodies targeting HIV-1. The studies described herein explore the development of novel trispecific binding proteins comprising four polypeptides forming three antigen binding sites that specifically bind three different epitopes on the HIV Env glycoprotein, and use of these novel trispecific binding proteins in neutralizing HIV-1.

Methods

Binding Protein Production and Purification

The vectors expressing the trispecific binding proteins were constructed by inserting the designed heavy and light chain genes into a mammalian expression vector. Corresponding heavy and light chain pairing occurred spontaneously, and heterodimer formation was promoted by Knob-in-Hole mutations engineered in the Fc region.

Binding proteins were produced in Expi293 cells by cotransfection of four expression plasmids (Life Technologies, Expi293™ Expression System Kit, Cat. No. A14635). Binding proteins were purified using a two-step purification scheme. First, binding proteins were captured on protein A affinity chromatography resin, washed, and then eluted in glycine at pH 3.0. The eluted proteins were then dialyzed in PBS, concentrated, and filtered. The filtered antibodies were further purified using a Superdex 200 SEC column to obtain monomeric binding proteins.

Affinity Measurements of the Binding Proteins

Binding affinities of anti-HIV trispecific binding proteins were measured by surface plasmon resonance (SPR) using a Biacore3000 instrument (GE Healthcare). The assay buffer used was HBS-EP (GE Healthcare).

The affinity of the indicated proteins for the MPER binding site on the HIV-1 protein gp41 was measured by surface plasmon resonance (SPR) analysis using a Biacore Instrument as follows: binding proteins were first captured on a CM5 chip coupled with anti-human Fc antibody, followed by flow through of varying concentrations (100 nM-6.25 nM) of the MPER binding peptide (Acetyl-RRR-NEQELLELDKWASLWNWFDITNWLWYIRRR-Ttds-Lys-(Biotin)-NH2) (SEQ ID NO: 284) at 30 µL per minute, and binding was detected by measurement of association for 240 seconds, and dissociation for 300 seconds on a Biacore 3000 at 25° C. HBS-EP buffer was used for sample dilution, as well as running buffer. Regeneration of the chip was done with 3 M $MgCl_2$ at 30 µL per minute. For data analysis the BIAevaluation software v.4.1 (GE Healthcare) was used. Data were fit globally using a 1:1 Langmuir model with mass transfer. After software-based curve fitting, the ON and OFF reates at each concentration of MPER binding peptide was calculated and used to obtain a binding affinity for each binding protein.

The affinity of the indicated proteins for the CD4BS binding site on the HIV-1 protein gp120 was measured by SPR as follows: recombinant HIV-1 gp120 (Thr27-Arg498) protein (HIV-1/Clade B/C (CN54), ARCO Biosystems (Cat. # GP4-V15227)) was captured on a CM5 chip, followed by flow through of varying concentrations (100 nM-6.25 nM) of the binding proteins, and binding was detected by measurement of association for 240 seconds, and dissociation for 300 seconds on a Biacore 3000 at 25° C. HBS-EP buffer was used for sample dilution, as well as running buffer. Regenration of the chip was done with 3 M $MgCl_2$ at 30 µL per minute. For data analysis the BIAevaluation software v.4.1 (GE Healthcare) was used. Data were fit globally using a 1:1 Langmuir model with mass transfer. After software-based curve fitting, the ON and OFF reates at each concentration of Binding Protein was calculated and used to obtain a binding affinity for each binding protein.

Conformational Stability and Aggregation Assays

Conformational stability of the trispecific binding proteins was assessed by determining the melting point $T_m$ and aggregation onset temperature ($T_{agg}$).

Melting point $T_m$ measurements were performed by differential scanning fluorimetry (DSF). Samples were diluted in D-PBS buffer (Invitrogen) to a final concentration of 0.2 µg/L including a 4× concentration solution of SYPRO-Orange dye (Invitrogen, 5000× stock in DMSO) in D-PBS in white sem-skirt 96-well plates (BIORAD). All measurements were done in duplicate using a MyiQ2 real time PCR instrument (BIORAD). Negative first derivative curves (−d (RFU)/dT) of the melting curves were generated in the iQ5 software v2.1 (BIORAD). Data were then exported into Excel for $T_m$ determination and graphical display.

Melting Point $T_m$ and aggregation onset temperature ($T_{agg}$) were also measured by static light scattering (SLS) using a Unit instrument (Unchained Labs). 9 µL of each sample was loaded undiluted into a multicuvette array. The samples were then heated from 20° C. to 95° C. at a heating rate of 0.3° C./minute. The barycentric mean (BCM) of the tryptophan fluorescence spectra was used to measure the protein melting curve, and determine the $T_m$ values. The 266 nm static light scattering (SLS) signal was used to measure the aggregation curve and determine the $T_{agg}$. Data analysis was performed using the Unit analysis software v2.1.

Results

A novel strategy was developed for improving neutralizing antibody efficacy against HIV-1, while concomitantly limiting the likelihood of viral breakthrough due to high sequence diversity and/or viral mutation. This strategy involved the generation of trispecific binding proteins comprising four polypeptides that formed three antigen binding sites that specifically bind three different epitopes on the HIV Env glycoprotein (FIG. 1). Each antigen binding site comprised the $V_H$ and $V_L$ domain from a different HIV-1 neutralizing antibody that targeted a distinct epitope on the Env glycoprotein. The trispecific binding proteins contained a first pair of polypeptides that possessed dual variable domains having a cross-over orientation forming two distinct antigen binding sites (called the CODV Ig format), and a second pair of polypeptides, each with a single variable domain that formed a third antigen binding site (FIGS. 1A and 1B).

The first pair of polypeptides (that possessed the dual variable domains) comprised a first polypeptide having the structure $V_{L2}$-Linker-$V_{L1}$-Linker-Immunoglobulin light chain constant domain, and a second polypeptide having the structure $V_{H1}$-Linker-$V_{H2}$-Linker-Immunoglobulin $C_{H1}$, hinge, $C_{H2}$, and $C_{H3}$ heavy chain constant domains, resulting in a pair of polypeptides which had a cross over orientation that formed two distinct antigen binding sites: $V_{H1}$-$V_{L1}$ and $V_{H2}$-$V_{L2}$ (FIGS. 1C and 1D, see light and heavy chains B). The second pair of polypeptides (that each possessed a single variable domain) comprised a first polypeptide having the structure $V_{H3}$-Immunoglobulin $C_{H1}$, hinge, $C_{H2}$, and $C_{H3}$ heavy chain constant domains, and a second polypeptide having the structure $V_{L3}$-Immunoglobulin light chain constant domain, resulting in a pair of polypeptides that formed a third antigen binding site: $V_{H3}$-$V_{L3}$ (FIGS. 1C and 1D, see light and heavy chains A). In addition, the trispecific binding proteins were constructed to include an LS mutation. Furthermore, the trispecific binding proteins were constructed such that within one binding protein, one $C_{H3}$ domain included a knob mutation and the other $C_{H3}$ domain included a hole mutation to facilitate heterodimerization of the heavy chains (FIG. 1).

Using the above described approach for trivalent binding protein design, three trispecific binding proteins (Binding Proteins 2, 3, and 24) were generated. These trispecific binding proteins were created by grafting onto a trispecific binding protein framework the $V_H$ and $V_L$ domains isolated from antibodies targeting three distinct epitopes on the HIV-1 Env glycoprotein: MPER Ab (targeting the MPER epitope on gp41), CD4BS Ab "b" (targeting the CD4 Binding Site on gp120), and V1/V2 directed Ab "a" (targeting the V1/V2 domain on gp120). Binding Protein 2 was constructed such that the first pair of polypeptides (which formed two antigen binding sites) targeted the HIV-1 Env glycoprotein epitopes MPER and V1/V2, and the second pair of polypeptides (which formed the single antigen binding site) targeted the HIV-1 Env glycoprotein epitope CD4BS (Binding Protein 2=MPER×V1/V2/CD4BS). Binding Protein 3 was constructed such that the first pair of polypeptides (which formed two antigen binding sites) targeted the HIV-1 Env glycoprotein epitopes V1/V2 and MPER, and the second pair of polypeptides (which formed the single antigen binding site) targeted the HIV-1 Env glycoprotein epitope CD4BS (Binding Protein 3=V1/V2×MPER/CD4BS). Binding Protein 24 was constructed such that the first pair of polypeptides (which formed two antigen binding sites) targeted the HIV-1 Env glycoprotein epitopes V1/V2 and CD4BS, and the second pair of polypeptides (which formed the single antigen binding site) targeted the HIV-1 Env glycoprotein epitope MPER (Binding Protein 24=V1/V2×CD4BS/MPER). The three trispecific binding proteins, as well as their parental antibodies, were purified over protein A affinity resin (FIGS. 2A and 3A) followed by size exclusion chromatography (FIGS. 2B and 3B) to obtain monomeric proteins suitable for further characterization. All three trispecific binding proteins were stable and formed monomers at high frequency.

To test the potential for developing binding proteins targeting two different HIV-1 Env protein epitopes (instead of three), bispecific binding proteins were designed based upon the above described CODV Ig format (See WO 2012/135345), using two different $V_H$ and $V_L$ domains from the same parental antibodies used to create the trispecific binding proteins. However, the bispecific binding proteins with these specific variable domains did not purify well as monomers, showing significantly increased aggregate formation when compared to the corresponding trispecific binding proteins (FIGS. 4A and 4B).

Next, the binding affinity of the purified trispecific binding proteins (and their parental antibodies) was measured for the HIV-1 Env glycoprotein epitopes on gp41 and gp120. First, the binding affinity for gp41 was measured for the three trispecific binding proteins, as well as the parental MPER antibody, by Biacore assay using the MPER binding peptide (FIG. 5). The binding affinity for the MPER antibody was calculated to be 18.7 nM. Surprisingly, the three trispecific binding proteins all had a higher affinity for the MPER binding peptide than did the parental antibody (Table 3), with Binding Protein 2 having an approximately 3.1 fold higher affinity than the MPER antibody (6.05 nM vs. 18.7 nM, respectively).

TABLE 3

Affinity measurements for the MPER binding peptide

| Antibody | Analyte | ka (1/Ms) | kd (1/s) | Rmax (RU) | KA (1/M) | KD (M) | Chi2 | MW MPER (kDa) |
|---|---|---|---|---|---|---|---|---|
| MPER Ab | Gp41-MPER JPT | 5.85E+04 | 1.09E−03 | 47.5 | 5.35E+07 | 1.87E−08 | 0.55 | 5.25 |
| Binding Protein 2 | Gp41-MPER JPT | 1.15E+05 | 6.97E−04 | 29.0 | 1.65E+08 | 6.05E−09 | 0.27 | 2.29 |
| Binding Protein 3 | Gp41-MPER JPT | 4.67E+04 | 7.79E−04 | 38.5 | 6.00E+07 | 1.67E−08 | 0.41 | 5.14 |
| Binding Protein 24 | Gp41-MPER JPT | 6.28E+04 | 8.06E−04 | 35.5 | 7.80E+07 | 1.28E−08 | 0.48 | 5.24 |

Figure 6:
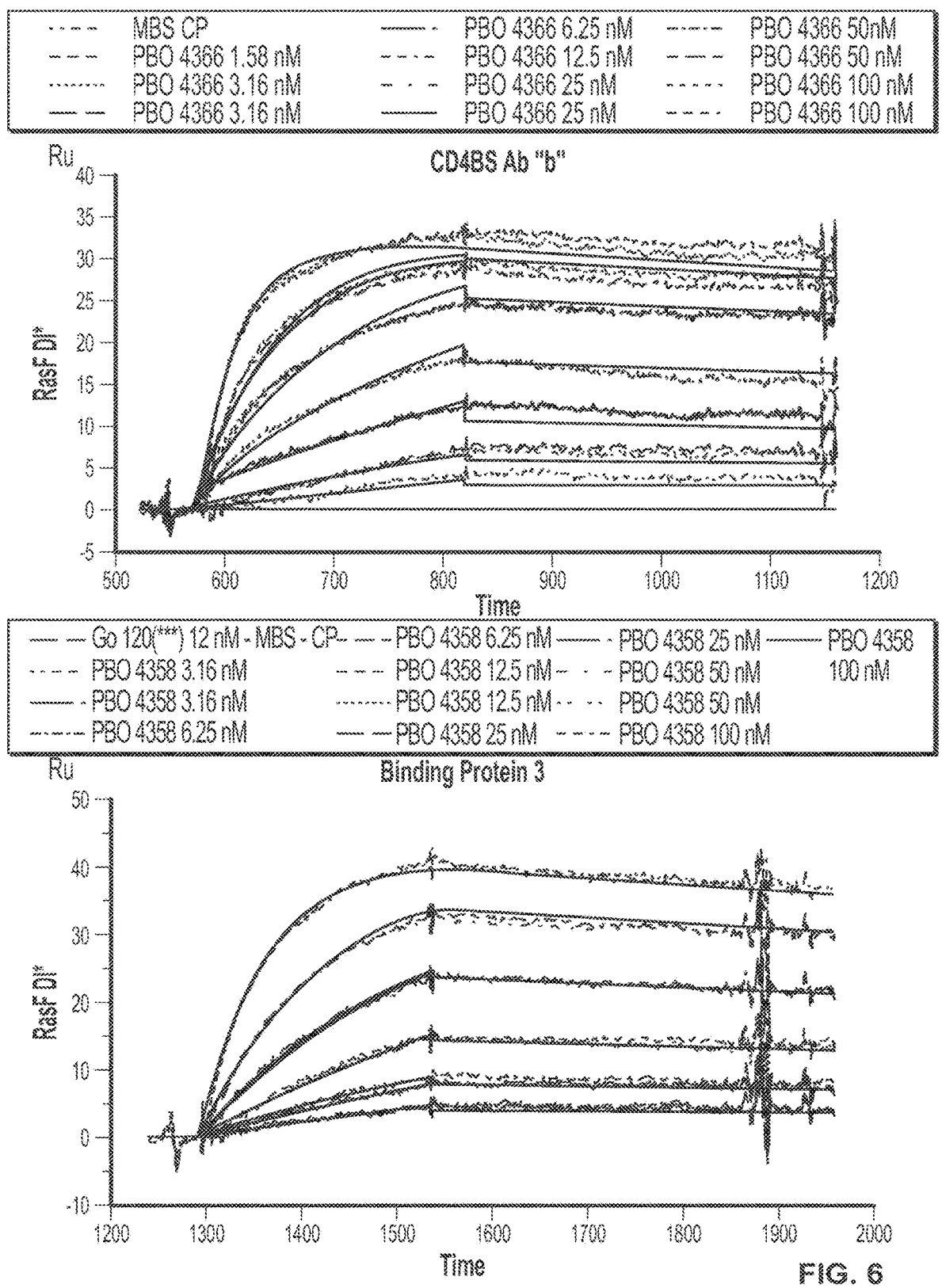
FIG. 6 shows the Biacore sensograms of the binding kinetics of three trispecific binding proteins and the parental CD4BS Ab "b" antibody for recombinant HIV gp120, as assessed by the standard Biacore-based kinetic assay.
Figure 6:
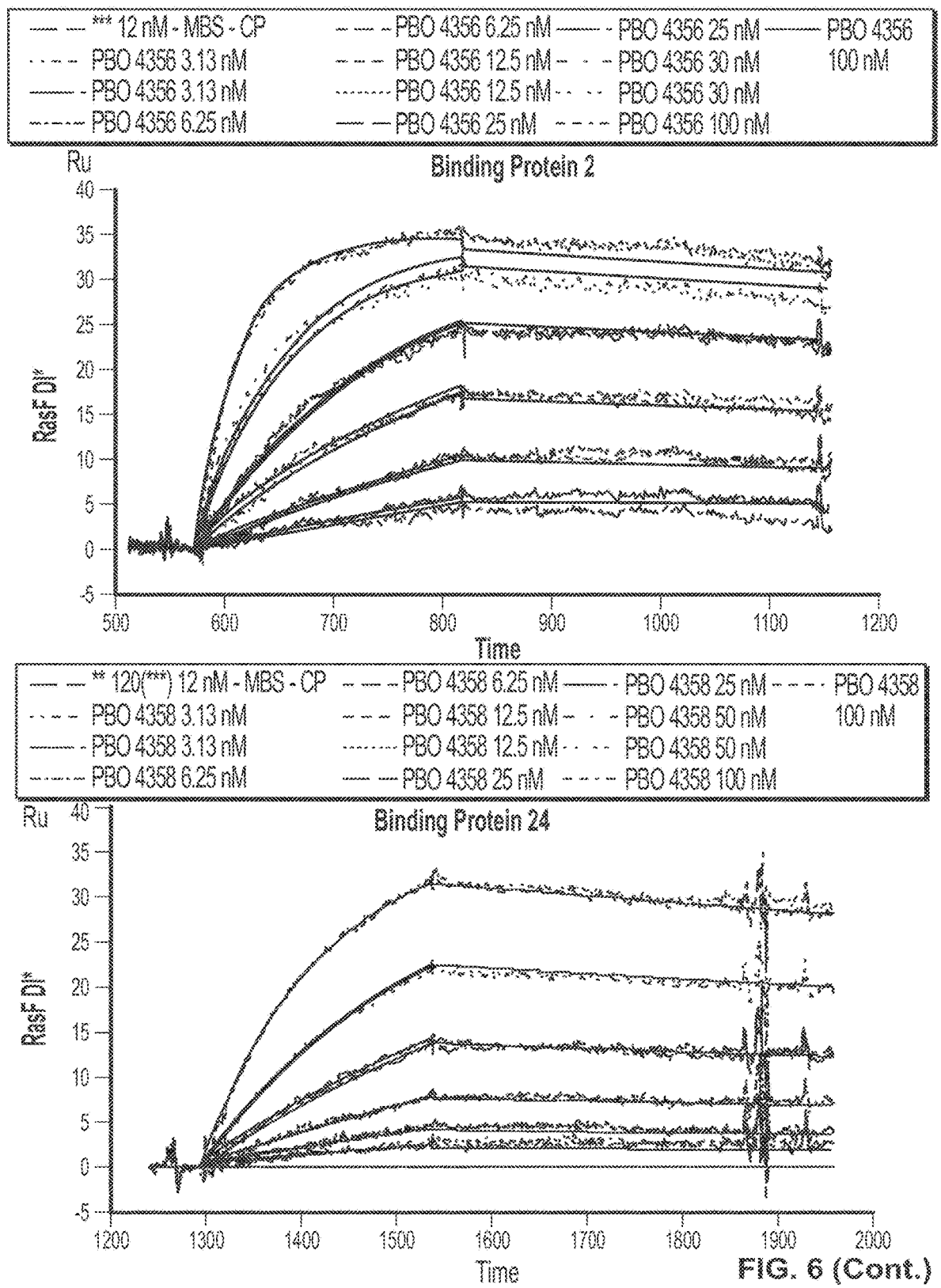

Similarly, the binding affinity for the CD4 Binding Site on gp120 was measured for the three trispecific binding proteins, as well as the parental CD4BS antibody, by Biacore assay (FIG. 6). The three trispecific binding proteins all had a similar affinity for the CD4 Binding Site when compared to the parental antibody (Table 4).

TABLE 4

Affinity measurements for the CD4BS binding site

| Antibody | ka (1/Ms) | kd (1/s) | Rmax (RU) | KD (M) | Chi2 |
|---|---|---|---|---|---|
| CD4BS Ab "b" | 2.79E+05 | 2.32E−04 | 31.4 | 8.30E−10 | 1.17 |
| Binding Protein 2 | 2.31E+05 | 2.41E−04 | 34.0 | 1.04E−09 | 0.74 |
| Binding Protein 3 | 7.58E+04 | 2.75E−04 | 38.2 | 3.63E−09 | 0.19 |
| Binding Protein 24 | 1.46E+05 | 2.52E−04 | 41.6 | 1.73E−09 | 0.38 |

Thus, the trispecific binding proteins were able to bind both of the tested target epitopes on the HIV-1 Env glycoprotein (Table 5). Moreover, all three trispecific binding proteins bound the target epitopes with affinities approximately equal to or exceeding those of their parental antibodies. Binding affinity of the V1/V2 directed Ab "a", as well as of the V1/V2 directed Ab "a" binding sites within the three trispecific binding proteins 2, 3, and 24 could not be determined by Biacore analysis because this required a specific gp120 protein antigen which was unavailable.

TABLE 5

Summary of binding capabilities of tested binding proteins

| Sample | Binding on gp120? | Binding on gp41? |
|---|---|---|
| MPER Ab | No | Yes |
| CD4BS Ab "b" | Yes | No |
| V1/V2 directed Ab "a" | No | No |
| Binding Protein 2 | Yes | Yes |
| Binding Protein 3 | Yes | Yes |
| Binding Protein 24 | Yes | Yes |

The biophysical properties were tested for the trispecific binding proteins and parental antibodies (Table 6). All of the tested proteins had similar stabilities and limited propensities to form aggregates.

TABLE 6

Conformational stability/aggregation of the binding proteins

| Sample | DSF $T_m$ (° C.) | Intrinsic AA Fluo $T_m$ (° C.) | SLS at 266 nm $T_{agg}$ (° C.) |
|---|---|---|---|
| MPER Ab | 69/75 | 68 | 71 |
| CD4BS Ab "b" | 69 | 66 | 68 |
| V1/V2 directed Ab "a" | 69 | 64 | 67 |
| Binding Protein 2 | 60/70 | 54 | 58 |
| Binding Protein 3 | 57/70 | 55 | 56 |
| Binding Protein 24 | 56/71 | 53 | 54 |

These experiments indicated that stable, monomeric, trispecific binding proteins targeting three distinct epitopes on the HIV-1 Env glycoprotein could be constructed and efficiently purified. Furthermore, the trispecific binding proteins retained their ability to bind their target epitopes, having similar or improved affinity relative to their parental antibodies. Finally, the trispecific binding proteins had suitable biophysical properties, and showed significantly less aggregation than the corresponding bispecific binding proteins.

Example 2: Characterization of the Binding Proteins

Due to the success of developing three trispecific binding proteins with appropriate biophysical properties and binding abilities (as described in Example 1), 21 additional trispecific binding proteins were developed and tested. The experiments described herein explored the ability of the 24 trispecific binding proteins to neutralize HIV-1 in vitro, and the pharmacokinetic properties of a number of these trispecific binding proteins in vivo.

Neutralization assays were performed using the TZM-bl assay which measures neutralization as a function of reductions in HIV-1 Tat-regulated firefly luciferase (Luc) reporter gene expression after a single round of infection with Env-pseudotyped viruses. The assays were performed as described in Marcella Sarzotti-Kelsoe et al., J. Immunological Methods, 409:131-146 (2014). The neutralization results of various antibodies are shown in Tables 8-10.

Methods

Production of Env-Pseudotyped Viruses

Assay stocks of Env-pseudotyped viruses were produced in 293T/17 cells by co-transfection with two plasmids: an Env expression plasmid and a plasmid expressing the entire HIV-1 genome except for Env. Co-transfection of these plasmids produced infectious pseudovirus particles which were capable of delivering the Tat gene into target cells, but infections with these pseudovirions could not themselves produce infectious viral progeny.

Viral Neutralization Assay

Neutralization of HIV infection using TZM-bl cells (also known as JC53BL-13 cells) was performed as described previously (Marcella Sarzotti-Kelsoe et al., J. Immunological Methods, 409:131-146 (2014)). Briefly, a single round of infection using the Env-pseudotyped HIV-1 virions was carried out in TZM-bl cells (a CXCR-4-positivie HeLa cell clone). TZM-bl cells were engineered to express CD4 and CCR5, and to contain integrated reporter genes for firefly luciferase and $E.\ coli$ β-galactosidase under the control of an HIV long-terminal repeat. Reporter gene expression was induced in trans by viral Tat protein (delivered by the pseudotyped viruses) soon after single cycle infection. Luciferase activity was quantified as relative luminescence units (RLU), and was directly proportional to the number of infectious virus particles present in the initial inoculum over a wide range of values. Neutralization was measured as a function of decreased Tat-regulated Firefly luciferase (Luc) reporter gene expression after administration of varying concentrations of the indicated binding proteins. Neutralization titers were identified as the protein dilution at which RLUs were reduced by 80% compared to virus control wells after subtraction of background RLUs. The assay was performed in 96-well plates for high throughput capacity, and well-characterized reference strains were utilized for uniformity across studies.

Pharmacokinetic (PK) Measurements

Female Indian rhesus macaques weighing between 3 and 6 kg were randomly assigned to groups according to body weight (two macaques per group) and were intravenously injected with the indicated concentration of binding proteins. Blood was collected from the animals before the injection on day 0, and 30 minutes, 6 hours, 1 day, 2 days, 4 days, 7 days, 14 days, 21 days and 28 days after injection. The serum concentration of each binding protein was quantified in the plasma from the collected blood using an RSC3-based ELISA assay.

Results 21 additional trispecific binding proteins targeting three distinct HIV-1 Env glycoprotein epitopes were generated and purified as described in Example 1. These 21 additional trispecific binding proteins (Binding Proteins 1 and 4-23) were created by grafting onto a trispecific binding protein framework the $V_H$ and $V_L$ domains isolated from antibodies targeting distinct HIV-1 epitopes on the HIV-1 Env glycoprotein: the anti-MPER antibodies MPER Ab "a" and MPER Ab "b" (targeting the MPER epitope on gp41), the anti-CD4BS antibodies CD4BSAb "a" and CD4BSAb "b" (targeting the CD4 Binding Site on gp120), the anti-V1/V2 antibodies V1/V2 directedAb "a" and V1/V2 directedAb "b" (targeting the V1/V2 domain on gp120), and the anti-V3 antibody V3 directedAb (targeting the V3 loop on gp120) (Table 7).

TABLE 7

Epitope binding site composition of the trispecific binding proteins

| Binding Protein: | Epitope Binding Site: |
| --- | --- |
| 1 | MPER × V1/V2 directed/CD4BS |
| 2 | MPER × V1/V2 directed/CD4BS |
| 3 | V1/V2 directed × MPER/CD4BS |
| 4 | MPER × V1/V2 directed/CD4BS |
| 5 | MPER × V3 directed/CD4BS |
| 6 | V1/V2 directed × MPER/CD4BS |
| 7 | V3 directed × V1/V2 directed/CD4BS |
| 8 | MPER × V1/V2 directed/CD4BS |
| 9 | MPER × V1/V2 directed/CD4BS |
| 10 | V1/V2 directed × MPER/CD4BS |
| 11 | MPER × V1/V2 directed/CD4BS |
| 12 | MPER × V3 directed/CD4BS |
| 13 | MPER × V3 directed/V1/V2 directed |
| 14 | V1/V2 directed × MPER/CD4BS |
| 15 | MPER × V3 directed/V1/V2 directed |
| 16 | MPER × V3 directed/CD4BS |
| 17 | V1/V2 directed × V3 directed/CD4BS |
| 18 | V3 directed × MPER/CD4BS |
| 19 | V3 directed × V1/V2 directed/MPER |
| 20 | V3 directed × V1/V2 directed/CD4BS |
| 21 | MPER × CD4BS/V1/V2 directed |
| 22 | CD4BS × MPER/V1/V2 directed |
| 23 | CD4BS × V1/V2 directed/MPER |
| 24 | V1/V2 directed × CD4BS/MPER |

The viral neutralization capabilities of five of the trispecific binding proteins (and their parental antibodies) at varying concentrations were tested against a panel of 208 different HIV-1 Env-pseudotyped viruses (Table 8). Binding protein-mediated neutralization of the pseudotyped HIV-1 isolates was measured using the TZM-bl luciferase reporter gene assay. The inhibitory dose for each binding protein was calculated for each pseudotyped virus as the dilution that caused an 80% reduction in luminescence ($IC_{80}$) after infection. Surprisingly, the $IC_{80}$ geometric means calculated for each of the tested trispecific binding proteins was lower than the parental antibodies, suggesting that these trispecific binding proteins were more potent at neutralizing pseudotyped HIV-1 than their parental neutralizing antibodies.

TABLE 8

$IC_{80}$ measurements from viral neutralization assay

| | Binding Protein: | | | | | | Parental Antibody: | | | | |
| --- | --- | --- | --- | --- | --- | --- | --- | --- | --- | --- | --- |
| | 15 | 1 | 2 | 19 | 20 | 3 | MPER Ab | V1/V2 directed Ab "a" | V3 directed Ab | CD4BS Ab "b" | CD4BS Ab "a" |
| # Viruses Total VS Neutralized: | 208 | 208 | 208 | 208 | 208 | 208 | 208 | 208 | 208 | 208 | 208 |
| $IC_{80}$ <50 μg/mL | 190 | 202 | 206 | 198 | 206 | 206 | 203 | 151 | 113 | 202 | 183 |
| $IC_{80}$ <10 μg/mL | 180 | 199 | 206 | 180 | 206 | 206 | 193 | 149 | 109 | 200 | 175 |
| $IC_{80}$ <1.0 μg/mL | 166 | 169 | 191 | 145 | 188 | 186 | 61 | 133 | 98 | 184 | 108 |

TABLE 8-continued

IC$_{80}$ measurements from viral neutralization assay

| | Binding Protein: | | | | | | MPER Ab | Parental Antibody: | | | |
|---|---|---|---|---|---|---|---|---|---|---|---|
| | | | | | | | | V1/V2 directed Ab "a" | V3 directed Ab | CD4BS Ab "b" | CD4BS Ab "a" |
| | 15 | 1 | 2 | 19 | 20 | 3 | | | | | |
| IC$_{80}$ <0.1 µg/mL | 122 | 109 | 136 | 80 | 144 | 123 | 10 | 99 | 72 | 79 | 10 |
| IC$_{80}$ <0.01 µg/mL | 74 | 7 | 70 | 22 | 54 | 47 | 5 | 24 | 26 | 6 | 0 |
| % VS Neutralized: | | | | | | | | | | | |
| IC$_{80}$ <50 µg/mL | 91 | 97 | 99 | 95 | 99 | 99 | 98 | 73 | 54 | 97 | 88 |
| IC$_{80}$ <10 µg/mL | 87 | 96 | 99 | 87 | 99 | 99 | 93 | 72 | 52 | 96 | 84 |
| IC$_{80}$ <1.0 µg/mL | 80 | 81 | 92 | 70 | 90 | 89 | 29 | 64 | 47 | 88 | 52 |
| IC$_{80}$ <0.1 µg/mL | 59 | 52 | 65 | 38 | 69 | 59 | 5 | 48 | 35 | 38 | 5 |
| IC$_{80}$ <0.01 µg/mL | 36 | 3 | 34 | 11 | 26 | 23 | 2 | 12 | 13 | 3 | 0 |
| Median IC$_{80}$ | 0.033 | 0.088 | 0.026 | 0.164 | 0.029 | 0.045 | 1.69 | 0.037 | 0.054 | 0.149 | 0.780 |
| Geometric Mean | 0.033 | 0.135 | 0.028 | 0.199 | 0.034 | 0.051 | 1.34 | 0.063 | 0.057 | 0.144 | 0.814 |

Next, the viral neutralization capabilities of a larger panel of trispecific binding proteins (and their parental antibodies) at varying concentrations were tested against 20 pseudo-typed viruses representing 10 different HIV-1 clades (Table 9). The trispecific binding proteins provided robust protection against infection with these 20 viruses (Table 10).

TABLE 9

20 representative viruses used for viral neutralization assay

| Virus | Clade |
|---|---|
| KER2008.12.SG3 | A |
| 620345.c1.SG3 | AE |
| DJ263.8.SG3 | AG |
| T266-60.SG3 | AG |
| T278-50.SG3 | AG |
| BL01.DG.SG3 | B |
| BR07.DG.SG3 | B |

TABLE 9-continued 20 representative viruses used for viral neutralization assay

| Virus | Clade |
|---|---|
| CNE57.SG3 | B |
| H086.8.SG3 | B |
| QH0692.42.SG3 | B |
| SS1196.01.SG3 | B |
| CNE21.SG3 | BC |
| 6471.V1.C16.SG3 | C |
| CAP210.E8.SG3 | C |
| DU156.12.SG3 | C |
| DU422.01.SG3 | C |
| TV1.29.SG3 | C |
| ZM106.9.SG3 | C |
| 3817.v2.c59.SG3 | CD |
| X2088.c9.SG3 | G |

TABLE 10

IC$_{80}$ measurements from viral neutralization assay of 20 representative viruses

| | | Total VS Neutralized | | % VS Neutralized | | | |
|---|---|---|---|---|---|---|---|
| | # Viruses | IC$_{80}$ <50 µg/mL | IC$_{80}$ <1 µg/mL | IC$_{80}$ <50 µg/mL | IC$_{80}$ <1 µg/mL | Median IC$_{80}$ | Geometric Mean |
| Binding Protein 4 | 20 | 17 | 11 | 85 | 55 | 0.474 | 0.398 |
| Binding Protein 5 | 20 | 14 | 11 | 70 | 55 | 0.199 | 0.324 |
| Binding Protein 6 | 20 | 16 | 9 | 80 | 45 | 0.453 | 0.449 |
| Binding Protein 7 | 20 | 16 | 9 | 80 | 45 | 0.523 | 0.312 |
| Binding Protein 8 | 20 | 17 | 12 | 85 | 60 | 0.578 | 0.488 |
| Binding Protein 9 | 20 | 14 | 9 | 70 | 45 | 0.836 | 0.531 |
| Binding Protein 10 | 20 | 16 | 12 | 80 | 60 | 0.222 | 0.173 |
| Binding Protein 11 | 20 | 18 | 15 | 90 | 75 | 0.310 | 0.181 |
| Binding Protein 12 | 20 | 17 | 12 | 85 | 60 | 0.526 | 0.566 |
| Binding Protein 13 | 20 | 19 | 12 | 95 | 60 | 0.202 | 0.189 |
| Binding Protein 14 | 20 | 17 | 15 | 85 | 75 | 0.208 | 0.088 |
| Binding Protein 15 | 20 | 17 | 10 | 85 | 50 | 0.345 | 0.378 |
| Binding Protein 16 | 20 | 18 | 11 | 90 | 55 | 0.228 | 0.314 |
| Binding Protein 17 | 20 | 17 | 12 | 85 | 60 | 0.086 | 0.180 |
| Binding Protein 18 | 20 | 15 | 10 | 75 | 50 | 0.536 | 0.501 |
| Binding Protein 19 | 20 | 18 | 11 | 90 | 55 | 0.563 | 0.538 |
| Binding Protein 20 | 20 | 18 | 14 | 90 | 70 | 0.224 | 0.229 |
| Binding Protein 21 | 20 | 15 | 9 | 75 | 45 | 0.627 | 0.501 |
| Binding Protein 2 | 20 | 18 | 13 | 90 | 65 | 0.375 | 0.222 |
| Binding Protein 22 | 20 | 13 | 8 | 65 | 40 | 0.856 | 0.634 |
| Binding Protein 23 | 20 | 17 | 6 | 85 | 30 | 1.930 | 1.129 |
| Binding Protein 3 | 20 | 18 | 12 | 90 | 60 | 0.469 | 0.287 |

TABLE 10-continued

IC$_{80}$ measurements from viral neutralization assay of 20 representative viruses

| | # Viruses | Total VS Neutralized | | % VS Neutralized | | Median IC$_{80}$ | Geometric Mean |
|---|---|---|---|---|---|---|---|
| | | IC$_{80}$ <50 µg/mL | IC$_{80}$ <1 µg/mL | IC$_{80}$ <50 µg/mL | IC$_{80}$ <1 µg/mL | | |
| Binding Protein 24 | 20 | 16 | 7 | 80 | 35 | 2.130 | 1.054 |
| MPER Ab "a" | 20 | 16 | 8 | 80 | 40 | 1.007 | 0.981 |
| MPER Ab "b" | 20 | 16 | 16 | 80 | 80 | 0.071 | 0.024 |
| CD4BS Ab "b" | 20 | 15 | 9 | 75 | 45 | 0.181 | 0.399 |
| V1/V2 directed Ab "a" | 20 | 11 | 9 | 55 | 45 | 0.060 | 0.094 |
| V3 directed Ab | 20 | 12 | 10 | 60 | 50 | 0.183 | 0.136 |
| CD4BS Ab "a" | 20 | 10 | 1 | 50 | 5 | 1.530 | 1.811 |
| V1/V2 directed Ab "b" | 20 | 9 | 9 | 45 | 45 | 0.051 | 0.039 |

Figure 7:
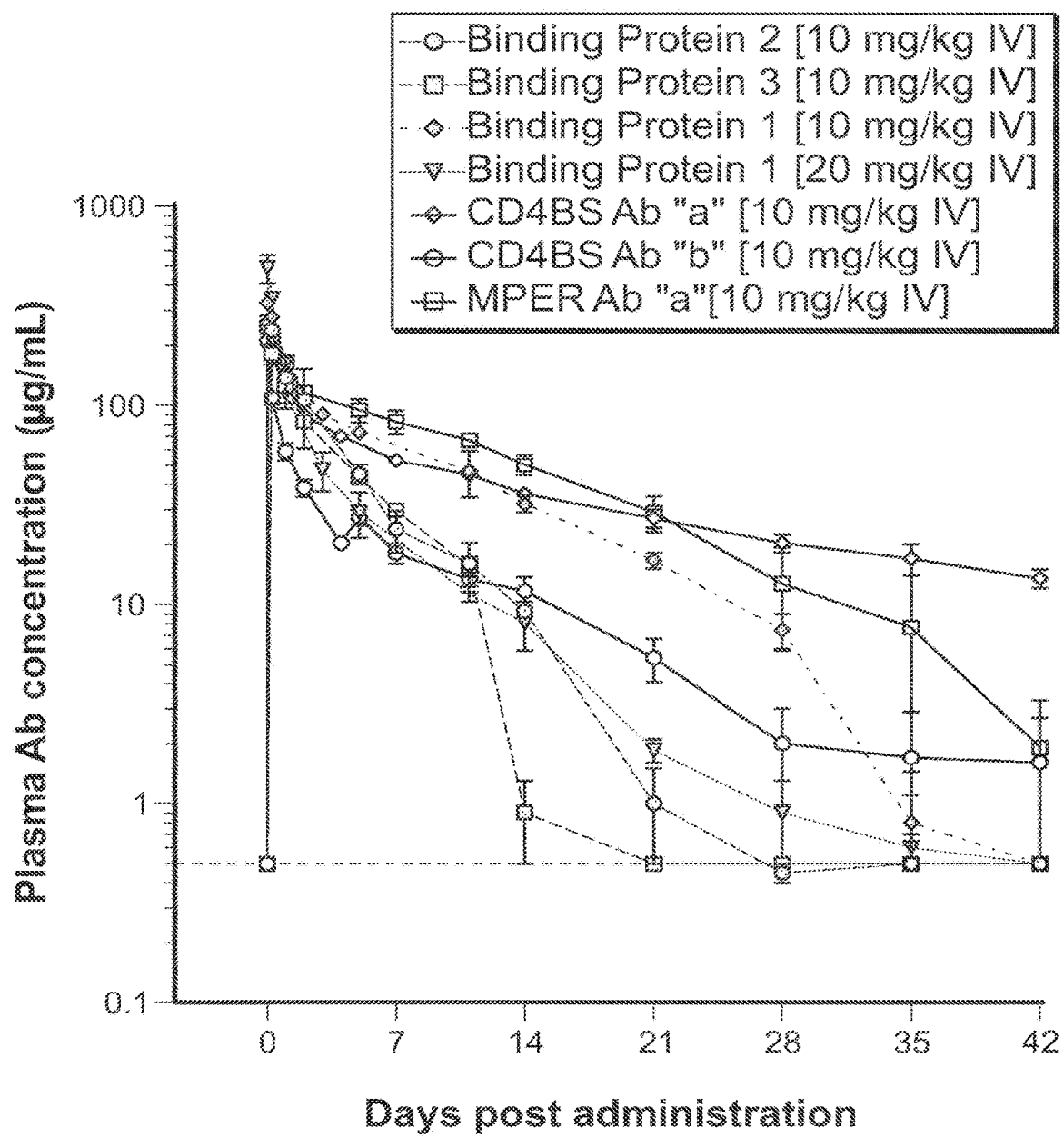
FIG. 7 shows the results of a pharmacokinetic (PK) study of the indicated proteins after intravenous (IV) injection in rhesus macaques.

Finally, the pharmacokinetics (PK) of a subset of the trispecific binding proteins and parental antibodies were tested in rhesus macaques. Briefly, 10 or 20 mg/kg of the proteins were intravenously injected into female rhesus macaques, and ELISA assays were performed on the plasma from blood samples taken prior to injection, and on the plasma from blood samples taken at many time points after the injection (up to 42 days) (FIG. 7). All of the trispecific binding proteins could be detected at least 14 days after IV administration, with Binding Protein 1 remaining detectable at least 35 days after injection, showing that the binding proteins were stable in vivo.

Taken together, this data suggested that broadly neutralizing trispecific binding proteins could be constructed which targeted three distinct epitopes on the HIV-1 Env glycoprotein. These binding proteins showed similar or increased potency/much improved neutralizing capabilities (breadth) relative to the parental neutralizing antibodies

Results

Figure 8A:
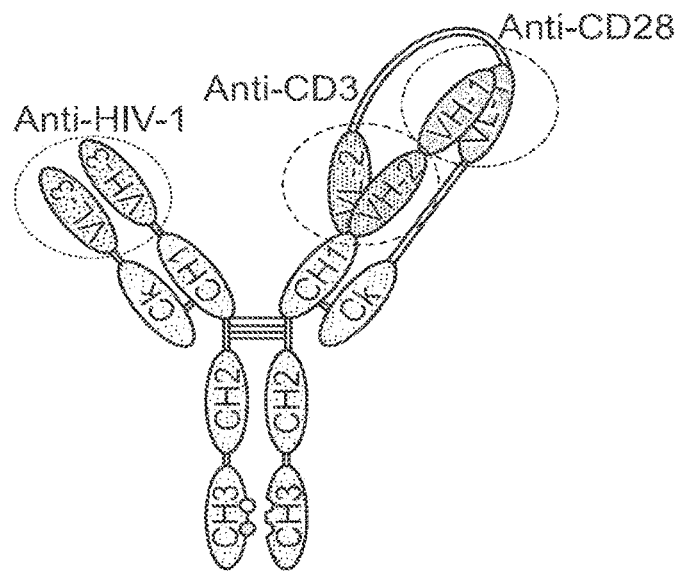
FIGS. 8A-8B show schematic representations of trispecific T-cell engagers, in accordance with some embodiments. The binding sites are indicated by the dotted circles.
Figure 8B:
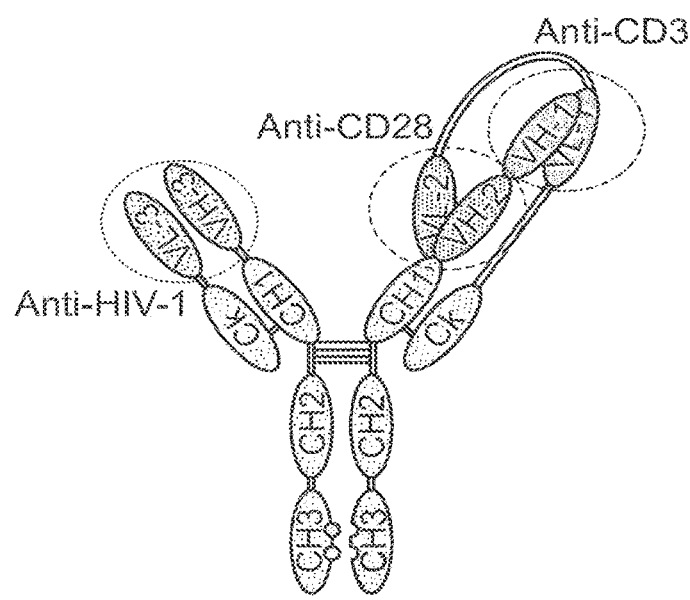

The capacity to develop T cell engagers with antigen binding sites targeting both T cell surface proteins and neutralizing epitopes on HIV-1 was explored. T cell engagers were constructed which contained two antigen binding sites targeting two different T cell surface receptors (CD3 and CD28), and a third antigen binding site targeting the HIV-1 Env glycoprotein (FIGS. 8A and 8B). In addition, the T cell engagers were constructed to include an LS mutation. Furthermore, the T cell engagers were constructed such that within one binding protein, one $C_{H3}$ domain included a knob mutation and the other $C_{H3}$ domain included a hole mutation to facilitate heterodimerization of the heavy chains (FIGS. 8A and 8B).

Using this approach, two T cell engagers were constructed which targeted both T cell surface proteins and the HIV-1 Env glycoprotein (Binding Protein 32 and CD3×CD28/CD4BS "b" Ab). These two T cell engagers were created by grafting onto a trispecific binding protein framework the $V_H$ and $V_L$ domains isolated from parental antibodies targeting the T cell surface proteins CD3 and CD28, and the anti-HIV-1 antibody CD4BS Ab "b" (targeting the CD4 Binding Site on gp120). Binding Protein 32 was constructed such that the first pair of polypeptides (which formed two antigen binding sites) targeted the T cell surface receptors CD28 and CD3, and the second pair of polypeptides (which formed the single antigen binding site) targeted the HIV-1 antigen CD4BS (Binding Protein 32=CD28×CD3/CD4BS). The CD3×CD28/CD4BS "b" Ab trispecific binding protein was constructed such that the first pair of polypeptides (which formed two antigen binding sites) targeted the T cell surface receptors CD3 and CD28, and the second pair of polypeptides (which formed the single antigen binding site) targeted the HIV-1 antigen CD4BS (Table 11).

TABLE 11

Format of T-cell engagers

| Format | Name of Construct | Arm 1 Antigen | Arm 2 Antigen | Arm 3 Antigen |
|---|---|---|---|---|
| T cell engagers, trispecific | CD3 × CD28/ CD4BS Ab "b" | CD4BS | CD3 | CD28 |
| T cell engagers, trispecific | Binding Protein 32 | CD4BS | CD28 | CD3 |
| Monospecific | CD4BS IgG4 | CD4BS | CD4BS | — |

Figure 9:
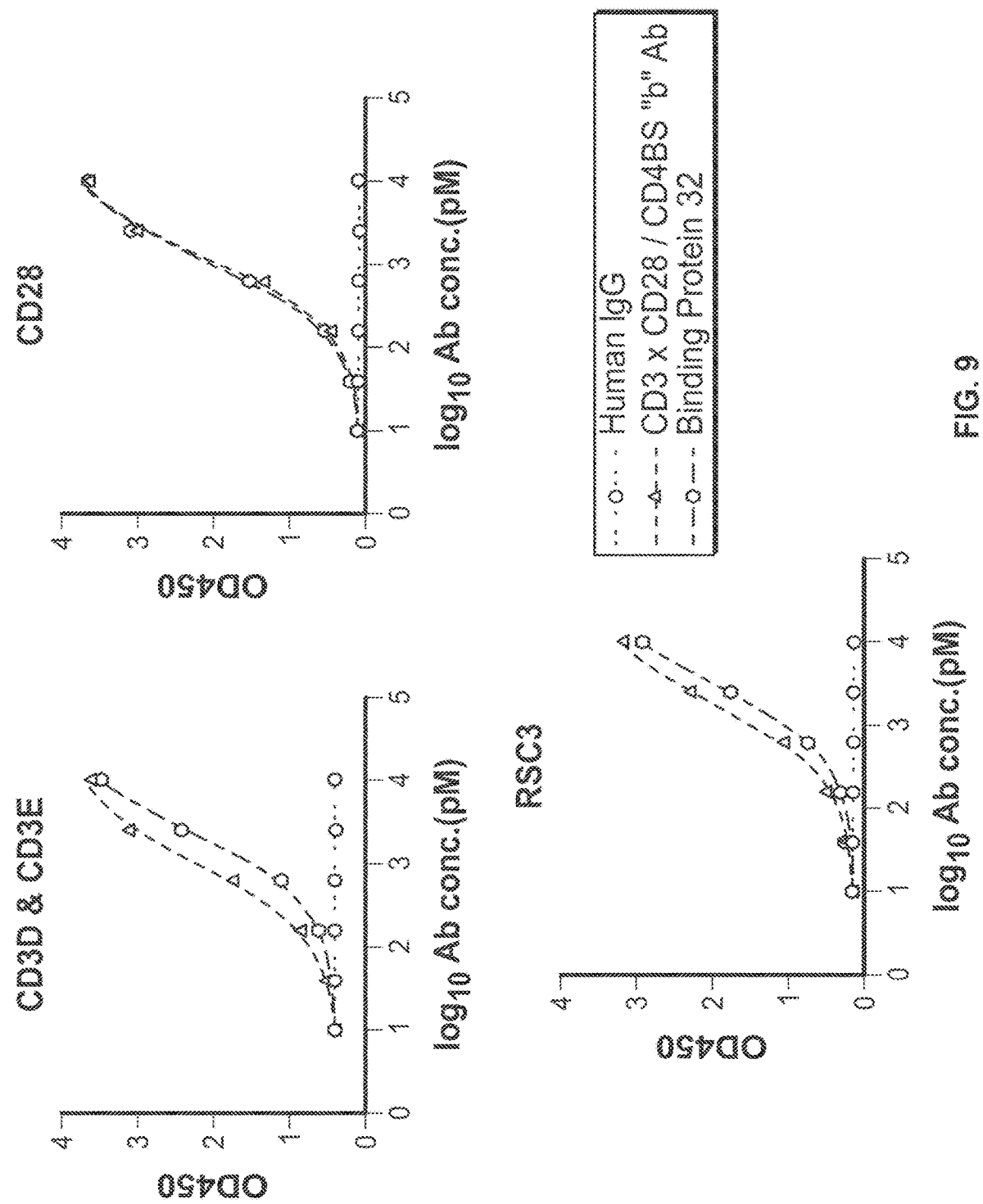
FIG. 9 shows binding properties of the trispecific binding proteins "Binding Protein 32" and "CD3×CD28/CD4BS Ab 'b'" to CD3 (CD3E represents CD3epsilon protein; CD3D represents CD3delta protein), CD28, and Resurfaced Stabilized Core 3 (RSC3) protein of gp120, as well as a negative control (human IgG).

The ability of the two T cell engagers to bind to each of their three target antigens was tested by ELISA assay. The T cell engagers were capable of binding both the CD3 and CD28 T cell surface proteins with the CD3 and CD28 antigen binding sites in either orientation in the bispecific arms of the T cell engagers (i.e., CD3×CD28 for CD3× CD28/CD4BS Ab "b" or CD28×CD3 for Binding Protein 32). Both T cell engagers were also capable of binding to gp120 (as measured using the HIV-1 RSC3 protein, a gp120 variant lacking the V1, V2, and V3 variable regions) (FIG. 9).

Figure 10:
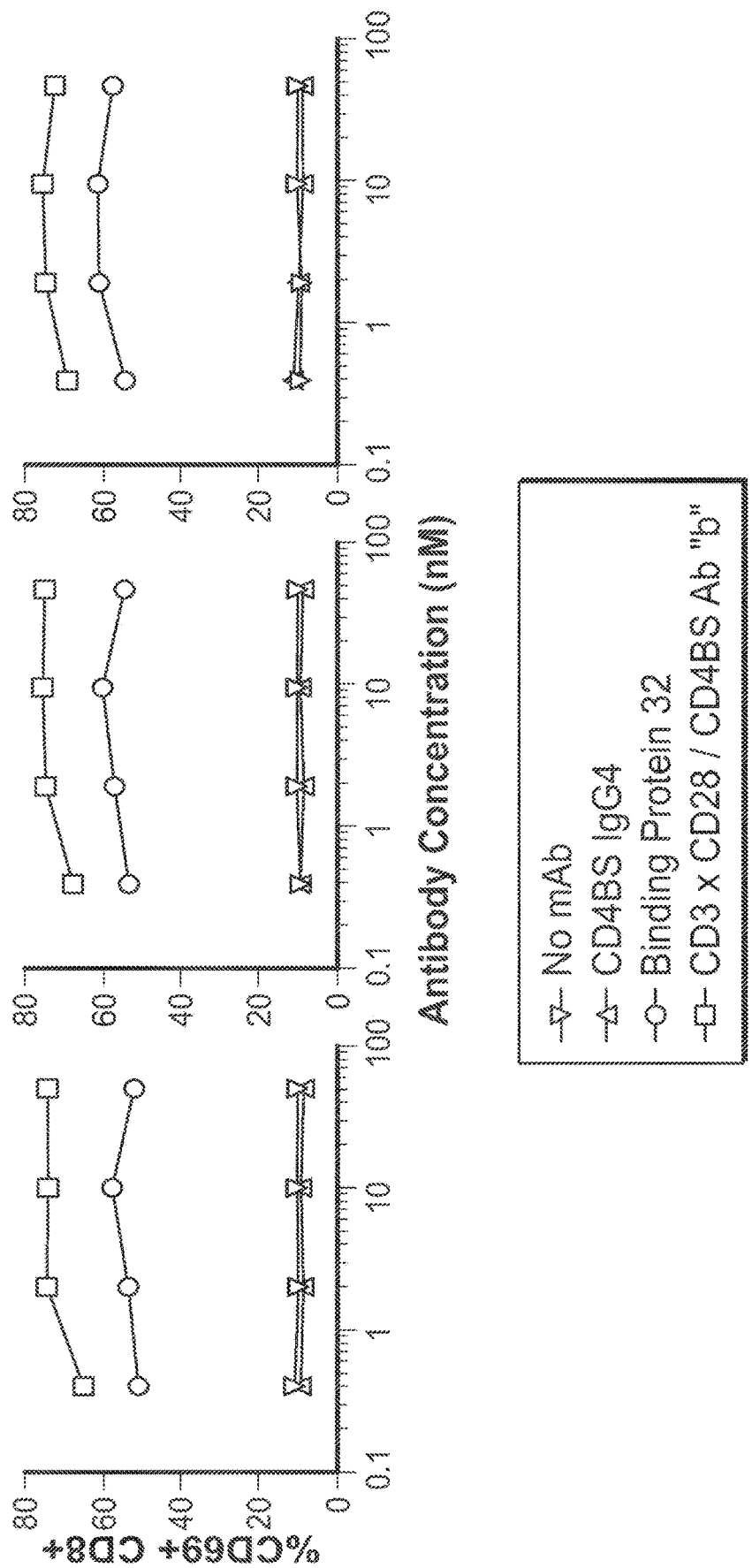
FIG. 10 shows CD8 T-cell activation using the trispecific proteins "Binding Protein 32" and "CD3×CD28/CD4BS Ab 'b'" compared to the parental CD4BS IgG4 antibody, as well as a negative control (No mAb).
Figure 11:
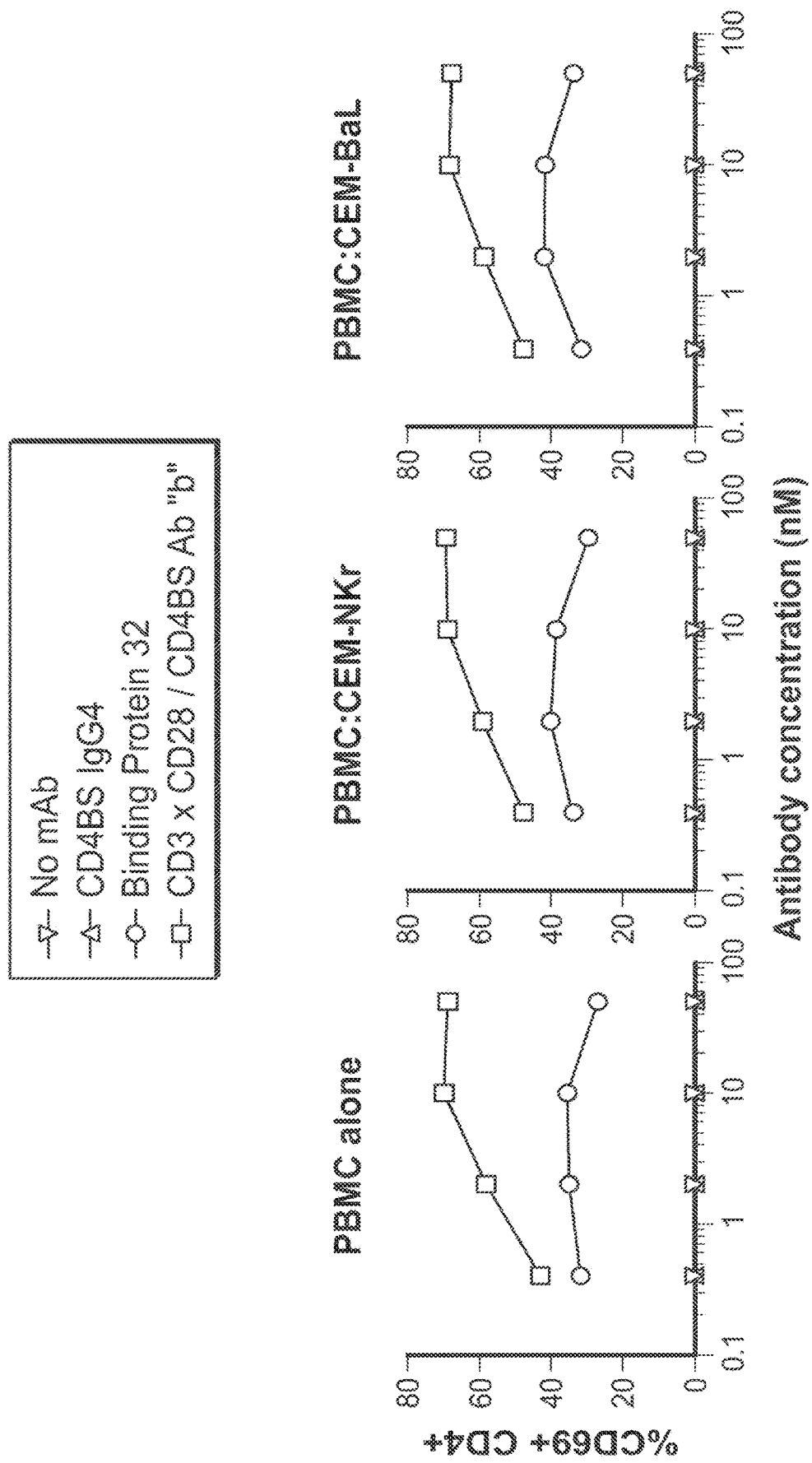
FIG. 11 shows CD4 T-cell activation using the trispecific proteins "Binding Protein 32" and "CD3×CD28/CD4BS Ab 'b'" compared to the parental CD4BS IgG4 antibody, as well as a negative control (No mAb).
Figure 12:
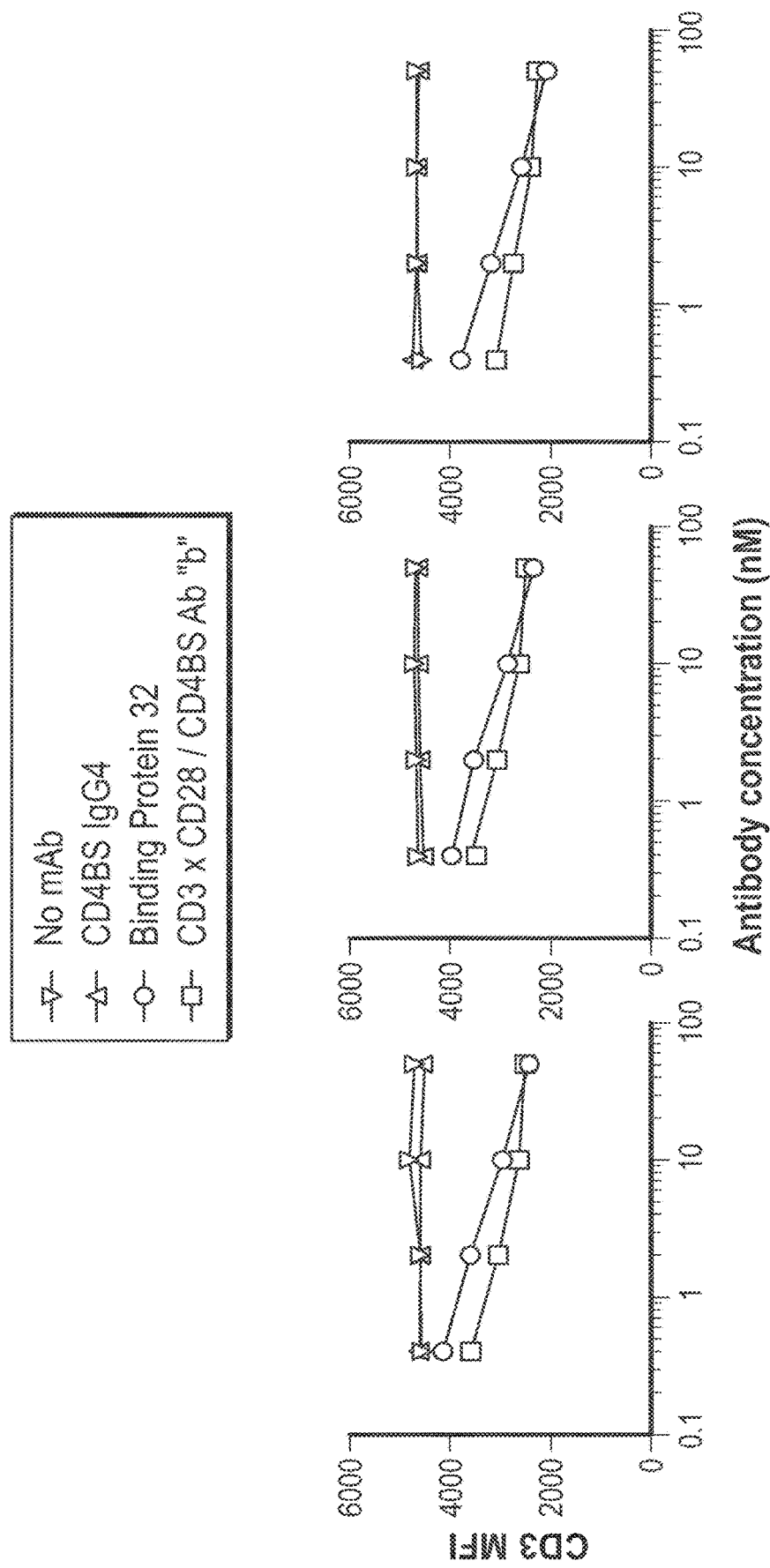
FIG. 12 shows CD3 downregulation after T cell activation by the trispecific proteins "Binding Protein 32" and "CD3× CD28/CD4BS Ab 'b'" compared to the parental CD4BS IgG4 antibody, as well as a negative control (No mAb).

The effect on T cell activity was next tested for both of the T cell engagers. Incubation of the T cell engagers with monocytes revealed that the T cell engagers induced robust CD8$^+$ T cell activation (FIG. 10). Similarly, the T cell engagers were capable of inducing significant CD4$^+$ T cell activation on PBMCs alone, or PBMCs incubated with either of the HIV-1 infected T cell lines CEM-NKr cells or CEM-BaL cells (FIG. 11). Additionally, both of the T cell engagers reduced cell surface expression of CD3 on activated T cells (FIG. 12).

Figures 13A, 13B, 13C:
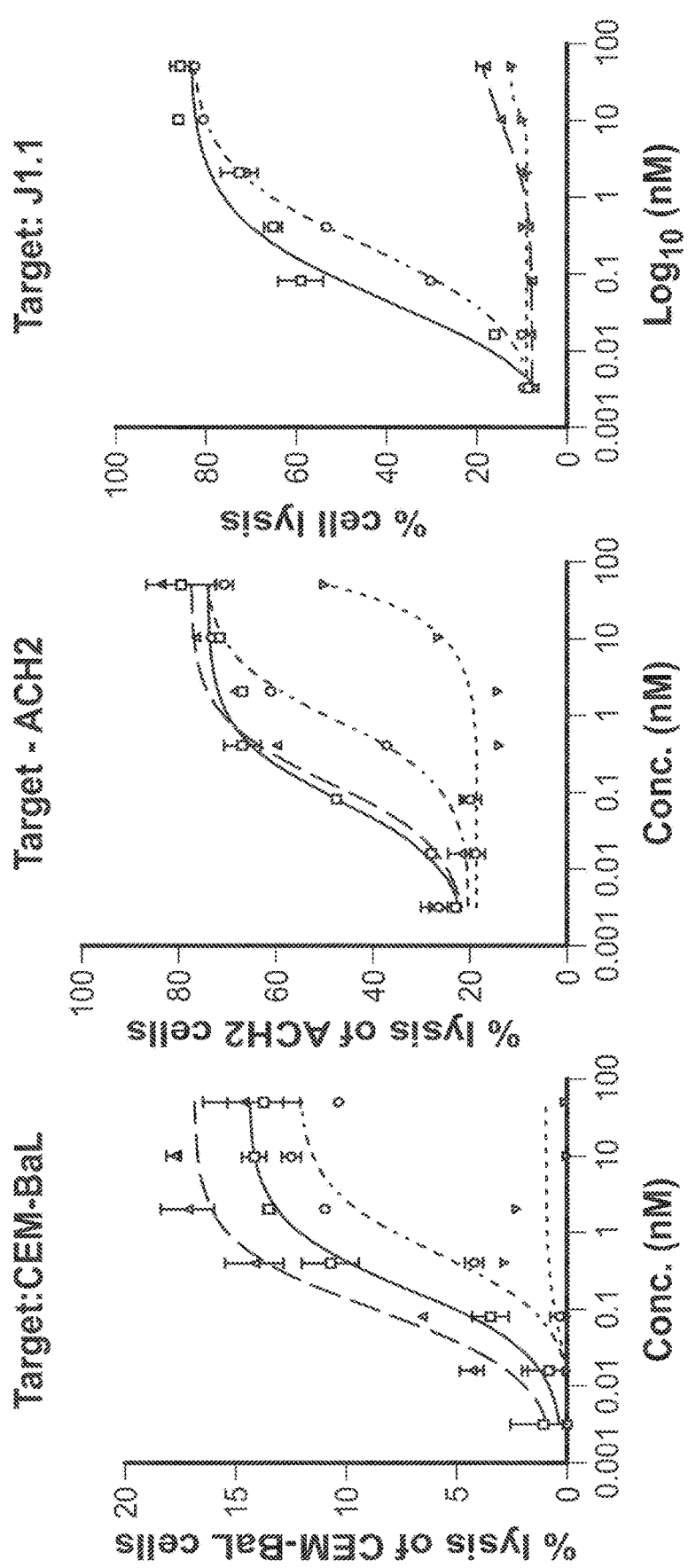
FIGS. 13A-C show fluorescence-activated cell sorting (FACS)-based cytotoxicity assay results for trispecific binding proteins against latently infected HIV-1$^+$ T cells.

Finally, the ability of the T cell engagers to induce lysis of HIV-infected cells was tested. The T cell engagers (and positive and negative control bispecific binding proteins targeting CD3 and an HIV antigen) were incubated with the HIV-1 infected T cell line CEM-BaL cells. Incubation of the T cell engagers with the infected cells induced robust cell lysis over a wide range of concentrations (FIG. 13A). Likewise, incubation of these T cell engagers induced lysis of the latently infected T cell line ACH2 cells (FIG. 13B), as well as J1.1 cells (FIG. 13C). Surprisingly, the T cell engagers showed comparable or better cytotoxic activity against chronic and latent HIV-infected cell lines when compared to the bispecific binding proteins.

Taken together, the novel T cell engagers described herein retained the ability from their parental antibodies to bind their target antigens on the HIV-1 Env glycoprotein gp120 on HIV-infected cells, as well as the cell-surface exposed T cell proteins CD3 and CD28. The T cell engagers induced robust CD4$^+$ and CD8$^+$ T cell activation, and diminished CD3 surface expression. Finally, these T cell engagers induced significant lysis of HIV-1 infected T cells. Without wishing to be bound by theory, these T cell engagers may provide a novel strategy for anti-viral therapeutics by reducing/eliminating the latent viral reservoir through T cell engagement in HIV/AIDS patients.

While the present disclosure includes various embodiments, it is understood that variations and modifications will occur to those skilled in the art. Therefore, it is intended that the appended claims cover all such equivalent variations that come within the scope of the disclosure. In addition, the section headings used herein are for organizational purposes only and are not to be construed as limiting the subject matter described.

Each embodiment herein described may be combined with any other embodiment or embodiments unless clearly indicated to the contrary. In particular, any feature or embodiment indicated as being preferred or advantageous may be combined with any other feature or features or embodiment or embodiments indicated as being preferred or advantageous, unless clearly indicated to the contrary.

All references cited in this application are expressly incorporated by reference herein.

TABLE 1

SEQUENCES
Heavy and light chain SEQ ID NOs for binding proteins 1-53 and the target antigens to which the binding proteins are directed.

| Binding Protein | SEQ ID NOs | Target |
|---|---|---|
| 1 | 4, 3, 1, 2 | MPER × V1/V2 directed/CD4BS |
| 2 | 12, 11, 9, 10 | MPER × V1/V2 directed/CD4BS |
| 3 | 20, 19, 17, 18 | V1/V2 directed × MPER/CD4BS |
| 4 | 28, 27, 25, 26 | MPER × V1/V2 directed/CD4BS |
| 5 | 36, 35, 33, 34 | MPER × V3 directed/CD4BS |
| 6 | 44, 43, 41, 42 | V1/V2 directed × MPER/CD4BS |
| 7 | 52, 51, 49, 50 | V3 directed × V1/V2 directed/CD4BS |
| 8 | 60, 59, 57, 58 | MPER × V1/V2 directed/CD4BS |
| 9 | 68, 67, 65, 66 | MPER × V1/V2 directed/CD4BS |
| 10 | 76, 75, 73, 74 | V1/V2 directed × MPER/CD4BS |
| 11 | 84, 83, 81, 82 | MPER × V1/V2 directed/CD4BS |
| 12 | 92, 91, 89, 90 | MPER × V3 directed/CD4BS |
| 13 | 100, 99, 97, 98 | MPER × V3 directed/V1/V2 directed |
| 14 | 108, 107, 105, 106 | V1/V2 directed × MPER/CD4BS |
| 15 | 116, 115, 113, 114 | MPER × V3 directed/V1/V2 directed |
| 16 | 124, 123, 121, 122 | MPER × V3 directed/CD4BS |
| 17 | 132, 131, 129, 130 | V1/V2 directed × V3 directed/CD4BS |
| 18 | 140, 139, 137, 138 | V3 directed × MPER/CD4BS |
| 19 | 148, 147, 145, 146 | V3 directed × V1/V2 directed/MPER |

TABLE 1-continued

SEQUENCES
Heavy and light chain SEQ ID NOs for binding proteins 1-53 and
the target antigens to which the binding proteins are directed.

| Binding Protein | SEQ ID NOs | Target |
|---|---|---|
| 20 | 156, 155, 153, 154 | V3 directed × V1/V2 directed/CD4BS |
| 21 | 164, 163, 161, 162 | MPER × CD4BS/V1/V2 directed |
| 22 | 172, 171, 169, 170 | CD4BS × MPER/V1/V2 directed |
| 23 | 180, 179, 177, 178 | CD4BS × V1/V2 directed/MPER |
| 24 | 188, 187, 185, 186 | V1/V2 directed × CD4BS/MPER |
| 25 | 196, 195, 193, 194 | MPER × V1/V2 directed/CD4BS |
| 26 | 204, 203, 201, 202 | MPER × V1/V2 directed/CD4BS |
| 27 | 212, 211, 209, 210 | MPER × V1/V2 directed/CD4BS |
| 28 | 220, 219, 217, 218 | MPER × V1/V2 directed/CD4BS |
| 29 | 228, 227, 225, 226 | MPER × V1/V2 directed/CD4BS |
| 30 | 235, 234, 232, 233 | MPER × V1/V2 directed/CD4BS |
| 31 | 243, 242, 240, 241 | MPER × V1/V2 directed/CD4BS |
| 32 | 305, 304, 302, 303 | CD28 × CD3/CD4BS |
| 33 | 313, 312, 310, 311 | CD28 × CD3/CD4BS |
| 34 | 321, 320, 318, 319 | CD28 × CD3/V1/V2 directed |
| 35 | 329, 328, 326, 327 | CD28 × CD3/V1/V2 directed |
| 36 | 337, 336, 334, 335 | CD28 × CD3/CD4BS |
| 37 | 345, 344, 342, 343 | CD28 × CD3/CD4BS |
| 38 | 353, 352, 350, 351 | CD4BS × CD3/CD28 |
| 39 | 361, 360, 358, 359 | CD4BS × CD3/CD28 |
| 40 | 369, 368, 366, 367 | CD3 × CD4BS/CD28 |
| 41 | 377, 376, 374, 375 | CD3 × CD4BS/CD28 |
| 42 | 385, 384, 382, 383 | CD4BS × CD3/CD28 |
| 43 | 393, 392, 390, 391 | CD4BS × CD3/CD28 |
| 44 | 401, 400, 398, 399 | CD3 × CD4BS/CD28 |
| 45 | 409, 408, 406, 407 | CD3 × CD4BS/CD28 |
| 46 | 417, 416, 414, 415 | V1/V2 directed × CD3/CD28 |
| 47 | 425, 424, 422, 423 | V1/V2 directed × CD3/CD28 |
| 48 | 433, 432, 430, 431 | CD3 × V1/V2 directed/CD28 |
| 49 | 441, 440, 438, 439 | CD3 × V1/V2 directed/CD28 |
| 50 | 449, 448, 446, 447 | V1/V2 directed × CD3/CD28 |
| 51 | 457, 456, 454, 455 | V1/V2 directed × CD3/CD28 |
| 52 | 465, 464, 462, 463 | CD3 × V1/V2 directed/CD28 |
| 53 | 473, 472, 470, 471 | CD3 × V1/V2 directed/CD28 |

TABLE 2

Heavy and light chain sequences of binding proteins. CDR sequences are bolded and italicized.

Binding Protein 1 Amino Acid Sequences

Heavy chain A: Qvqlvqsggqmkkpgesmriscrasgyefi*dctln*wirlapgkrpewmg*wlk prggavnyarplqg*rvtmtrdvysdtaflelrsltvddtavyfctr*gkncdynwdf eh*wgrgtpvivssastkgpsvfplapssskstsggtaalgclvkdyfpepvtvswn sgaltsgvhtfpavlqssglyslssvvtvpssslgtqtyicnvnhkpsntkvdkkve pkscdkthtcppcpapellqgpsvflfppkpkdtlmisrtpevtcvvvdvshedp evkfnwyvdgvevhnaktkpreeqynstyrvvsvltvlhqdwlngkeykckvs nkalpapiektiskakgqprepqvctlppsrdeltknqvslscavkgfypsdiave wesngqpennykttppvldsdgsfflvskltvdksrwqqgnvfscsvlhealhsh ytqkslslspg — SEQ ID NO: 1

Light chain A: Eivltqspgtlslspgetaiisc*rtsqygsla*wyqqrpgqaprlviy*sgstr*gipd rfsgsrwgpdynltisnlesgdfgvyy*cqqyef*fgqgtkvqvdikrtvaapsvfif ppsdeqlksgtasvvcllnnfypreakvqwkvdnalqsgnsqesvteqdskdst yslsstltlskadyekhkvyacevthqglsspvtksfnrgec — SEQ ID NO: 2

Heavy chain B: Evrlvesgggglvkpggslrlscsasg*gfdfdnaw*mtwvrqppgkglewvgr*itg pgegwsv*dyaesvkgrftisrdntkntlylemnnvrtedtgyyfcart*gkyydfw sgyppeeyfqd*wgqgtlvivssdkthtastkgpsvfplapssskstsggtaalgclvkdyfpepvtvswns galtsgvhtfpavlqssglyslssvvtvpssslgtqtyicnvnhkpsntkvdkkvep kscdkthtcppcpapellggpsvflfppkpkdtlmisrtpevtcvvvdvshedpe vkfnwyvdgvevhnaktkpreeqynstyrvvsvltvlhqdwlngkeykckvs nkalpapiektiskakgqprepqvytlppcrdeltknqvslwclvkgfypsdiave wesngqpennykttppvldsdgsfflyskltvdksrwqqgnvfscsvlhealhsh ytqkslslspg — SEQ ID NO: 3

Light chain B: Dfvltqsphslsvtpgesasisckss*hslihgdrnny*lawyvqkpgrspqlliy*la dktht*aseltqdpavsvalkqtvtltc*rgdslrshyas*wyqkkpgqapvllfy*gknnrps* gipdrfsgsasgnrasltitgaqaedeadyyc*ssrdksgsrlsv*fgggtkltvldkth trtvaapsvfifppsdeqlksgtasvvclinnfypreakvqwkvdnalqsgnsqes vteqdskdstyslsstltlskadyekhkvyacevthqglsspvtksfnrgec — SEQ ID NO: 4

Binding Protein 1 Nucleotide Sequences

Heavy chain A: caggtgcagctggtgcagtctggcggccagatgaagaaacccggcgagagcatgc gcatcagctgcagagccagcggctacgagttcatcgactgcaccctgaactggatc agactggccccctggcaagcggcctgagtggatgggatggctgaagcctagaggcg gagccgtgaactacgccagaccctctgcagggcagagtgaccatgacccgggacgt gtacagcgataccgccttcctggaactgcgcagcctgaccgtggatgataccgccgt gtacttctgcacccggggcaagaactgcgactacaactgggacttcgagcactggg gcagaggcacccctgtgatcgtgtcaagcgcgtcgaccaagggcccagcgtgttc — SEQ ID NO: 5

TABLE 2-continued

Heavy and light chain sequences of binding proteins. CDR sequences are bolded and italicized.

|  |  |  |
|---|---|---|
|  | cctctggcccctagcagcaagagcacatctggcggaacagccgccctgggctgcct<br>cgtgaaggactactttcccgagcccgtgaccgtgtcctggaattctggcgccctgac<br>cagcggcgtgcacaccttccagctgtgctgcagtccagcggcctgtacagcctgag<br>cagcgtcgtgacagtgcccagcagctctctgggcacccagacctacatctgcaacgt<br>gaaccacaagcccagcaacaccaaggtggacaagaaggtggaacccaagagctg<br>cgacaagacccacacctgtcccccttgtcctgccccgaactgctgggaggcccttc<br>cgtgttcctgttccccccaaagcccaaggacaccctgatgatcagcggaccccg<br>aagtgacctgcgtggtggtggatgtgtcccacgaggaccctgaagtgaagttcaatt<br>ggtacgtggacggcgtggaagtgcacaacgccaagaccaagccaagagaggaac<br>agtacaacagcacctaccgggtggtgtccgtgctgaccgtgctgcaccaggactgg<br>ctgaacggcaaagagtacaagtgcaaggtgtccaacaaggccctgcctgcccccat<br>cgagaaaaccatcagcaaggccaagggccagccccgcgaaccccaggtgtgcac<br>actgcccccaagcagggacgagctgaccaagaaccaggtgtccctgagctgtgcc<br>gtgaaaggcttctacccctccgatatcgccgtggaatgggagagcaacggccagcc<br>cgagaacaactacaagaccacccccctgtgctggacagcgacggctcattcttcct<br>ggtgtccaagctgacagtggacaagtcccggtggcagcagggcaacgtgttcagct<br>gctccgtgctgcacgaggccctgcacagccactacacccagaagtccctgagcctg<br>agccccggc |  |
| Light<br>chain<br>A | Gagatcgtgctgacacagagccctggcaccctgagcctgtctccaggcgagacag<br>ccatcatcagctgccggacaagccagtacggcagcctggcctggtatcagcagag<br>gcctggacaggcccccagactcgtgatctacagcggcagcacaagagccgccgg<br>aatccccgatagattcagcggctccagatggggccctgactacaacctgaccatcag<br>caacctggaaagcggcgacttcggcgtgtactactgccagcagtacgagacttcgg<br>ccagggcaccaaggtgcaggtggacatcaagcgtacggtggccgctcccagcgtg<br>ttcatcttcccaccctagcgacgagcagctgaagtccggcacagcctctctgtcgtgtgcc<br>tgctgaacaacttctaccccgcgaggccaaagtgcagtggaaggtggacaacgcc<br>ctgcagagcggcaacagccaggaaagcgtgaccgagcaggacagcaaggactc<br>cacctacagcctgagcagcaccctgacactgagcaaggccgactacgagaagcac<br>aaggtgtacgcctgcgaagtgacccaccagggcctgtctagccccgtgaccaaga<br>gcttcaaccggggcgagtgt | SEQ ID<br>NO: 6 |
| Heavy<br>chain<br>B | gaggttagactggtggagtcaggagggggcttgtgaagcccggtgggtctctccg<br>cctgagctgttctgcctccggctttgatttcgataacgcctggatgacctgggtcaggc<br>agcctccaggtaagggactggagtgggtgggaagaatcacagctccaggcgagg<br>gctggtccgtgactacgcggaatctgttaaagggcggtttacaatctcaagggaca<br>ataccaagaataccttgtatttggagatgaacaacgtgagaactgaagacaccggat<br>attacttctgtgccagaacaggcaaatactacgacttctggtccggctatcccctggc<br>gaggaatattttcaagactggggtcagggaacccttgttatcgtgtcctccgacaaaa<br>cccatacccaggtgcacctgacacagagcggacccgaagtgcggaagcctggca<br>cctctgtgaaggtgtcctgcaaggcccctggcaacaccctgaaaacctacgacctgc<br>actgggtgcgcagcgtgccaggacagggactgcagtggatgggctggatcagcca<br>cgagggcgacaagaaagtgatcgtggaacggttcaaggccaaagtgaccatcgac<br>tgggacagaagcaccaacaccgcctacctgcagctgagcggcctgacctctggcg<br>ataccgccgtgtactactgcgccaagggcagcaagcaccggctgagagactacgc<br>cctgtacgacgatgacggcgccctgaactgggccgtggatgtggactacctgagca<br>acctggaattctggggccagggcacagccgtgaccgtgtcatctgataagacccac<br>accgcttccaccaagggcccatcggtcttccccctggcaccctcctccaagagcacc<br>tctggggcacagcggccctgggctgcctggtcaaggactacttccccgaaccggt<br>gacggtgtcgtggaactcaggcgccctgaccagcggcgtgcacaccttcccggctg<br>tcctacagtcctcaggactctactccctcagcagcgtggtgaccgtgccctccagca<br>gcttgggcacccagacctacatctgcaacgtgaatcacaagcccagcaacaccaag<br>gtggacaagaaagttgagcccaaatcttgtgacaaaactcacacatgcccaccgtgc<br>ccagcacctgaactcctggggggaccgtcagtcttcctcttccccccaaaacccaag<br>gacaccctcatgatctcccggacccctgaggtcacatgcgtggtggtggacgtgag<br>ccacgaagaccctgaggtcaagttcaactggtatgttgacggcgtggaggtgcataa<br>tgccaagacaaagccgcgggaggagcagtacaacagcacgtaccgtgtggtcagc<br>gtcctcaccgtcctgcaccaggactggctgaatggcaaggagtacaagtgcaaggt<br>ctccaacaaagccctcccagccccatcgagaaaaccatctccaaagccaaaggg<br>cagccccgagaaccacaggtgtacaccctgcccccatgcgcgggatgagctgacca<br>agaatcaagtcagcctgtggtgcctggtaaaaggcttctatcccagcgacatcgccgt<br>ggagtgggagagcaatgggcagccggagaacaactacaagaccacgcctcccgt<br>gctggactccgacggctccttcttcctctactcaaaactcaccgtggacaagagcag<br>gtggcagcaggggaacgtcttctcatgctccgtgctgcatgaggctctgcacagcca<br>ctacacgcagaagagcctctccctgtctccgggt | SEQ ID<br>NO: 7 |
| Light<br>chain<br>B | gacttcgtgctgacccagagccctcacagcctgagcgtgacacctggcgagagcg<br>cagcatcagctgcaagagcagccactccctgatccacggcgaccggaacaacta<br>cctggcttggtacgtgcagaagcccggcagatcccccagctgctgatctacctggc<br>cagcagcagagccagcggcgtgcccgatagattttctggcagcggcagcgacaag<br>gacttcaccctgaagatcagccgggtggaaaccgaggacgtgggcacctactactg<br>tatgcagggcagagagagcccctgaccttggccagggcaccaaggtggaacatc<br>aaggacaaaacccataccgcatccgaactgactcaggaccctgccgtctctgtggc<br>actgaagcagactgtgactattacttgccgaggcgactcactgcggagccactacgc<br>ttcctggtatcagaagaaacccggccaggcacctgtgctgctgttctacggaaagaa<br>caataggccatctggcatcccgaccgcttttctggcagtgcatcagggaaccgagc<br>cagtctgaccattaccggcgcccaggctgaggacgaagccgattactattgcagctc | SEQ ID<br>NO: 8 |

TABLE 2-continued

Heavy and light chain sequences of binding proteins. CDR sequences are bolded and italicized.

```
ccgggataagagcggctccagactgagcgtgttcggaggaggaactaaactgacc
gtcctcgataagacccataccgtacggtggccgctcccagcgtgttcatcttcccac
ctagcgacgagcagctgaagtccggcacagccctctgtcgtgtgcctgctgaacaact
tctaccccgcgaggccaaagtgcagtggaaggtggacaacgccctgcagagcg
gcaacagccaggaaagcgtgaccgagcaggacagcaaggactccacctacagcc
tgagcagcaccctgacactgagcaaggccgactacgagaagcacaaggtgtacgc
ctgcgaagtgacccaccagggcctgtctagccccgtgaccaagagcttcaaccggg
gcgagtgt
```

Binding Protein 2 Amino Acid Sequences

| | | |
|---|---|---|
| Heavy chain A | Rahlvqsgtamkkpgasvrvscqts*qytftahi*fwfrqapgrglewvgw*ikpq* *ygav*nfgggfrdrvtltrdvyreiaymdirglkpddtavyycard*rsygdsswald* *a*wgqgttvvvsaastkgpsvfplapssksts qgtaalgclvkdyfpepvtvswns galtsqvhtfpavlqssqlyslssvvtvpssslgtqtyicnvnhkpsntkvdkkvep kscdkthtcppcpapellggpsvflfppkpkdtlmisrtpevtcvvvdvshedpe vkfnwyvdgvevhnaktkpreeqynstyrvvsvltvlhqdwlngkeykckvsn kalpapiektiskakgqprepqvctlppsrdeltknqvslscavkqfypsdiavew esngqpennykttppvldsdgsfflvskltvdksrwqqgnvfscsvlhealhshyt qkslslspg | SEQ ID NO: 9 |
| Light chain A | tyihvtqspsslsvsigdrvtincqts*qgvgsd*hwyqhkpgrapkllihhtssved gvpsrfsgsg*hts*fnltisdlqaddiatyyc*qvlqf*grgsrlhikrtvaapsvfifpp sdeqlksgtasvvcllnnfypreakvqwkvdnalqsgnsqesvteqdskdstysl ssltltlskadyekhkvyacevthqglsspvtksfnrgec | SEQ ID NO: 10 |
| Heavy chain B | Evrlvesggglvkpggslrlscsasgfdfdnawmtwvrqppgkglewv grritgpgegwsvdyaesvkgrftisrdntkntlylemnnvrtedtgyyfcar tgkyydfwsgyppgeeyfqdwgqgtlvivssdkthtqvhltqsgpevrk pgtsvkvsckapgntlktydlhwvrsvpgqglqwmgwishegdkkviv erfkakvtidwdrstntaylqlsgltsgdtavyycakgskhrlrdyalyddd galnwavdvdylsnlefwgqgtavtvssdkthtastkgpsvfplapsskst sggtaalgclvkdyfpepvtvswnsgaltsgvhtfpavlqssglyslssvvt vpssslgtqtyicnvnhkpsntkvdkkvepkscdkthtcppcpapellgg psvflfppkpkdtlmisrtpevtcvvvdvshedpevkfnwyvdgvevhn aktkpreeqynstyrvvsvltvlhqdwlngkeykckvsnkalpapiektis kakgqprepqvytlppcrdeltknqvslwclvkgfypsdiavewesngq pennykttppvldsdgsfflyskltvdksrwqqgnvfscsvlhealhshyt qkslslspg | SEQ ID NO: 11 |
| Light chain B | dfvltqsphslsvtpgesasisckss hslihgdrnnylawyvqkpgrspqlliylass rasgvpdrfsgsgsdkdftlkisrvetedvgtyycmqgrespwtfgqgtkvdikd kthtaseltqdpavsvalkqtvtitcrgdslrshyaswyqkkpgqapvllfygknnr psgipdrfsgsasgnrasltitgaqaedeadyycsrdksgsrlsvfgggtkltvldk thtrtvaapsvfifppsdeqlksgtasvvcllnnfypreakvqwkvdnalqsgnsq esvteqdskdstyslsstltlskadyekhkvyacevthqglsspvtksfnrgec | SEQ ID NO: 12 |

Binding Protein 2 Nucleotide Sequences

| | | |
|---|---|---|
| Heavy chain A | agagcccacctggtgcagtctggcaccgccatgaagaaaccaggcgcctctgtgc ggtgtcctgtcagacaagcggctacaccttcaccgccacatcctgttctggttccg gcaggcccctggcagaggactggaatgggtgggatggatcaagccccagtatggc gccgtgaacttcggcggaggcttccgggatagagtgaccctgacccgggacgtgta ccgcgagatcgcctacatggacatccggggcctgaagcccgatgacaccgccgtg tactactgcgccagagacagaagctacggcgacagcagctgggctctggatgcttg gggccagggcacaaccgtggtgtgtctgccgcctctacaaaagggcccagcgtg ttccctctggccctagcagcaagagcacatctggcggaacagccgccctgggctg cctcgtgaaggactactttcccgagcccgtgaccgtgtcctggaattctggcgccctg accagcggcgtgcacacctttccagctgtgctgcagtccagcggcctgtacagcctg agcagcgtcgtgacagtgcccagcagctctctgggcacccagacctacatctgcaa cgtgaaccacaagcccagcaacaccaaggtggacaagaaggtggaacccaagag ctgcgacaagacccacacctgtcccccttgtcctgccccgaactgctgggaggcc cttccgtgttcctgttccccccaaagcccaaggacaccctgatgatcagccggaccc ccgaagtgacctgcgtggtggtggatgtgtcccacgaggaccctgaagtgaagttca attggtacgtggacggcgtggaagtgcacaacgccaagacccaagccaagagagg aacagtacaacagcacctaccgggtggtgtccgtgctgaccgtgctgcaccaggac tggctgaacggcaaagagtacaagtgcaaggtgtccaacaaggccctgcctgccc catcgagaaaaccatcagcaaggccaagggccagccccgcgaacccc aggtgtg cacactgccccaagcagggacgagctgaccaagaaccaggtgtccctgagctgt gccgtgaaaggcttctacccctccgatatcgccgtggaatgggagagcaacggcca gcccgagaacaactacaagaccacccccctgtgctggacagcgacggctcattct tcctggtgtccaagctgacagtggacaagtcccggtggcagcagggcaacgtgttc agctgctccgtgctgcacgaggccctgcacagccactacacccagaagtccctgag cctgagccccggc | SEQ ID NO: 13 |
| Light chain | ttacatccacgtgacccagagccccagcagcctgtccgtgtccatcggcgacagagt gaccatcaactgccagacctctcagggcgtgggcagcgacctgcactggtatcagc | SEQ ID NO: 14 |

TABLE 2-continued

Heavy and light chain sequences of binding proteins. CDR sequences are bolded and italicized.

| | | |
|---|---|---|
| A | acaagcctggcagagcccccaagctgctgatccaccacacaagcagcgtggaaga tggcgtgcccagcagatttccggcagcggcttccacaccagcttcaacctgaccat cagcgatctgcaggccgacgacattgccacctactattgtcaggtgctgcagttcttc ggcagaggcagcagactgcacatcaagcgtacggtggccgctcccagcgtgttcat cttcccacctagcgacgagcagctgaagtccggcacagcctctgtcgtgtgcctgct gaacaacttctaccccgcgaggccaaagtgcagtggaaggtggacaacgccctg cagagcggcaacagccaggaaagcgtgaccgagcaggacagcaaggactccac ctacagcctgagcagcaccctgacactgagcaaggccgactacgagaagcacaag gtgtacgcctgcgaagtgacccaccagggcctgtctagccccgtgaccaagagctt caaccggggcgagtgt | |
| Heavy chain B | gaggttagactggtggagtcaggagggggcttgtgaagcccggtgggtctctccg cctgagctgactgcctccggctttgatttcgataacgcctggatgacctgggtcaggc agcctccaggtaagggactggagtgggtgggaagaatcacaggtcaggcgagg gctggtccgtggactacgcggaatctgttaaagggcggtttacaatctcaagggaca ataccaagaataccttgtatttggagatgaacaacgtgagaactgaagcaccggat attacttctgtgccagaacaggcaaatactacgacttctggtccggctatcccctggc gaggaatattttcaagactgggtcagggaaccttgttatcgtgtcctccgacaaaa cccataccaggtgcacctgacacagagcggacccgaagtgcggaagcctggca cctctgtgaaggtgtcctgcaaggcccctggcaacaccctgaaaacctacgacctgc actgggtgcgcagcgtgccaggacagggactgcagtggatgggctggatcagcca cgagggcgacaagaaagtgatcgtggaacggttcaaggccaaagtgaccatcgac tgggacagaagcaccaacaccgcctacctgcagctgagcggcctgacctctggcg ataccgccgtgtactactgcgccaagggcagcaagcaccggctgagagactacgc cctgtacgacgatgacggcgccctgaactgggccgtggatgtggactacctgagca acctggaattctggggccagggcacagaccgtgaccgtgtcatctgataagacccac accgcttccaccaagggcccatcggtcttccccctggcacctcctccaagagcacc tctgggggcacagcggcctgggctgcctggtcaaggactacttccccgaaccggt gacggtgtcgtggaactcaggcgccctgaccagcggcgtgcacaccttcccggctg tcctacagtcctcaggactctactccctcagcagcgtggtgaccgtgccctccagca gcttgggcacccagacctacatctgcaacgtgaatcacaagcccagcaacaccaag gtggacaagaaagttgagcccaaatcttgtgacaaaactcacacatgcccaccgtgc ccagcacctgaactcctgggggaccgtcagtcttcctcttccccccaaaacccaag gacaccctcatgatctcccggacccctgaggtcacatgcgtggtggtggacgtgag ccacgaagaccctgaggtcaagttcaactggtatgttgacggcgtggaggtgcataa tgccaagacaaagccgcgggaggagcagtacaacagcacgtaccgtgtggtcagc gtcctcaccgtcctgcaccaggactggctgaatggcaaggagtacaagtgcaaggt ctccaacaaagccctcccagcccccatcgagaaaaccatctccaaagccaaaggg cagccccgagaaccacaggtgtacaccctgcccccatgccgggatgagctgacca agaatcaagtcagcctgtggtgcctggtaaaaggcttctatcccagcgacatcgccgt ggagtgggagagcaatgggcagccggagaacaactacaagaccacgcctcccgt gctggactccgacggctccttcttcctctactcaaaactcaccgtggacaagagcag gtggcagcaggggaacgtcttctcatgctccgtgctgcatgaggctctgcacagcca ctacacgcagaagagcctctccctgtctccgggt | SEQ ID NO: 15 |
| Light chain B | gacttcgtgctgacccagagccctcacagcctgagcgtgacacctggcgagagcg cagcatcagctgcaagagcagccactccctgatccacggcgaccggaacaacta cctggcttggtacgtgcagaagcccggcagatcccccagctgctgatctacctggc cagcagcagagccagcggcgtgcccgatagattttctggcagcggcagcgacaag gacttcacccctgaagatcagccgggtggaaaccgaggacgtgggcacctactactg tatgcagggcagagagagcccctggacctttggccagggcaccaaggtggacatc aaggacaaaacccataccgcatccgaactgactcaggaccctgccgtctctgtggc actgaagcagactgtgactattacttgccgaggcgactcactgcggagccactacgc ttcctggtatcagaagaaacccggccaggcacctgtgctgctgttctacggaaagaa caataggccatctggcatccccgaccgcttttctggcagtgcatcagggaaccgagc cagtctgaccattaccggcgccaggctgaggacgaagccgattactattgcagctc ccgggataagagcggctccagactgagcgtgttcggaggaggaactaaactgacc gtcctcgataagacccatacccgtacggtggccgctcccagcgtgttcatcttcccac ctagcgacgagcagctgaagtccggcacagcctctgtcgtgtgcctgctgaacaact ctaccccgcgaggccaaagtgcagtggaaggtggacaacgccctgcagagcg gcaacagccaggaaagcgtgaccgagcaggacagcaaggactccacctacagcc tgagcagcaccctgacactgagcaaggccgactacgagaagcacaaggtgtacgc ctgcgaagtgacccaccagggcctgtctagccccgtgaccaagagcttcaaccggg gcgagtgt | SEQ ID NO: 16 |

Binding Protein 3 Amino Acid Sequences

| | | |
|---|---|---|
| Heavy chain A | yrahlvqsgtamkkpgasvrvscqtsgytftahilfwfrqapgrglewvgwikpqy ingavnfgggfrdrvtltrdvyreiaymdirglkpddtavyycardrsygdsswalda wgqgttvvvsaastkgpsvfplapsskstsggtaalgclvkdyfepvtvswnsg altsgvhtfpavlqssglyslssvvtvpssslgtqtyicnvnhkpsntkvdkkvepk scdkthtcppcpapellggpsvflfppkpkdtlmisrtpevtcvvvdvshedpev kfnwyvdgvevhnaktkpreeqynstyrvvsvltvlhqdwlngkeykckvsnk alpapiektiskakgqprepqvctlppsrdeltknqvslscavkgfypsdiavewe sngqpennykttppvldsdgsfflvskltvdksrwqqgnvfscsvlhealhshytq kslslspg | SEQ ID NO: 17 |

TABLE 2-continued

Heavy and light chain sequences of binding proteins. CDR sequences are bolded and italicized.

| | | |
|---|---|---|
| Light chain A | yihvtqspsslsvsigdrvtincqtsqgvgsdlhwyqhkpgrapkllihhtssved vpsrfsgsgsfhtsfnltisdlqaddiatyycqvlqffgrgsrlhikrtvaapsvfifpp sdeqlksgtasvvcllnnfypreakvqwkvdnalqsgnsqesvteqdskdstysl sstltlskadyekhkvyacevthqglsspvtksfnrgec | SEQ ID NO: 18 |
| Heavy chain B | Qvhltqsgpevrkpgtsvkvsckapgntlktydlhwvrsvpgqglqwm wishegdkkviverfkakvtidwdrstntaylqlsgltsgdtavyycakg skhrlrdyalydddgalnwavdvdylsnlefwgqgtavtvssdkthtevrl vesgggglvkpggslrlscsasgfdfdnawmtwvrqppgkglewvgritg pgegwsvdyaesvkgrftisrdntkntlylemnnvrtedtgyyfcartgky ydfwsgyppgeeyfqdwgqgtlvivssdkthtastkgpsvfplapssskst sggtaalgclvkdyfpepvtvswnsgaltsgvhtfpavlqssglyslssvvt vpssslgtqtyicnvnhkpsntkvdkkvepkscdkthtcppcpapellgg psvflfppkpkdtlmisrtpevtcvvvdvshedpevkfnwyvdgvevhn aktkpreeqynstyrvvsvltvlhqdwlngkeykckvsnkalpapiektis kakgqprepqvytlppcrdeltknqvslwclvkgfypsdiavewesngq pennykttppvldsdgsfflyskltvdksrwqqgnvfscsvlhealhshyt qkslslspg | SEQ ID NO: 19 |
| Light chain B | taseltqdpavsvalkqtvtitcrgdslrshyaswyqkkpgqapvllfygknnrpsg nipdrfsgsasgnrasltitgaqaedeadyycssrdksgsrlsvfgggtkltvldkthtd fvltqsphslsvtpgesasisckssshslihgdrnnylawyvqkpgrspqlliylassr asgvpdrfsgsgsdkdftlkisrvetedvgtyycmqgrespwtfgqgtkvdikdk thtrtvaapsvfifppsdeqlksgtasvvcllnnfypreakvqwkvdnalqsgnsq esvteqdskdstyslsstltlskadyekhkvyacevthqglsspvtksfnrgec | SEQ ID NO: 20 |

Binding Protein 3 Nucleotide Sequences

| | | |
|---|---|---|
| Heavy chain A | agagcccacctggtgcagtctggcaccgccatgaagaaaccaggcgcctctgtgc ggtgtcctgtcagacaagcggctacaccttcaccgcccacatcctgttctggttccg gcaggcccctggcagaggactggaatgggtgggatggatcaagccccagtatggc gccgtgaacttcggcggaggcttccgggatagagtgaccctgaccgggacgtgta ccgcgagatcgcctacatggacatccggggcctgaagcccgatgacaccgccgtg tactactgcgccagagacagaagctacggcgacagcagctgggctctggatgcttg gggccagggcacaaccgtggtgtctgccgcctctacaaagggcccagcgtg ttccctctggccccctagcagcaagagcacatctggcggaacagccgccctgggctg cctcgtgaaggactactttcccgagccgtgaccgtgtcctggaattctggcgccctg accagcggcgtgcacaccttccagctgtgctgcagtccagcggcctgtacagcctg agcagcgtcgtgacagtgcccagcagctctctgggcacccagacctacatctgcaa cgtgaaccacaagcccagcaacaccaaggtggacaagaaggtggaacccaagag ctgcgacaagacccacacctgtcccccttgtcctgcccccgaactgctggaggcc cttccgtgttcctgttcccccaaagcccaaggacaccctgatgatcagccggaccc ccgaagtgacctgcgtggtggtggatgtgtcccacgaggacctgaagtgaagttca attggtacgtggacggcgtggaagtgcacaacgccaagaccaagccaagagagg aacagtacaacagcacctaccgggtggtgtccgtgctgaccgtgctgcaccaggac tggctgaacggcaaagagtacaagtgcaaggtgtccaacaagggccctgcctgccc catcgagaaaaccatcagcaaggccaaggcagccccgcgaaccccaggtgtg cacactgccccaagcaggacgagctgaccaagaaccaggtgtccctgagctgt gccgtgaaaggcttctaccctccgatatcgccgtggaatgggagagcaacggcca gcccgagaacaactacaagaccacccccctgtgctggacagcgacggctcattct tcctggtgtccaagctgacagtggacaagtcccgtggcagcagggcaacgtgttc agctgctccgtgctgcacgaggccctgcacagccactacacccagaagtccctgag cctgagcccggc | SEQ ID NO: 21 |
| Light chain A | ttacatccacgtgacccagagccccagcagcctgtccgtgtccatcggcgacagagt gaccatcaactgccagacctctcagggcgtgggcagcgacctgcactggtatcagc acaagcctggcagagcccccaagctgctgatccaccacacaagcagcgtggaaga tggcgtgcccagcagattttccggcagcggcttccacaccagcttcaacctgaccat cagcgatctgcaggccgacgacattgccacctactattgtcaggtgctgcagttcttc ggcagaggcagcgagactgcacatcaagcgtacggtggccgctcccagcgtgttcat cttcccaccctagcgacgagcagctgaagtccggcacagcctcgtcgtgtgcctgct gaacaacttctaccccgcgaggccaaagtcagtggaaggtggacaacgccctg cagagcggcaacagccaggaaagcgtgaccgagcaggacagcaaggactccac ctacagcctgagcagcaccctgacactgagcaaggccgactacgagaagcacaag gtgtacgcctgcgaagtgacccaccagggcctgtctagccccgtgaccaagagctt caaccggggcgagtgt | SEQ ID NO: 22 |
| Heavy chain B | caggtgcacctgacacagagcggacccgaagtgcggaagcctggcaccctc tgtgaaggtgtcctgcaaggcccctggcaacaccctgaaaacctacgacctg cactgggtgcgcagcgtgccaggacagggactgcagtggatgggctggat cagccacgagggcgacaagaaagtgatcgtggaacggttcaaggccaaag tgaccatcgactgggacagaagcaccaacaccgcctacctgcagctgagcg gcctgaccctctggcgataccgccgtgtactactgcgccaagggcagcaagc accggctgagagactaccgcctgtacgacgatgacggcgccctgaactgg gccgtggatgtggactacctgagcaacctggaattctggggccagggcaca gccgtgaccgtgtcatctgacaaaacccataccgaggttagactggtggagt caggagggggcttgtgaagcccgtgggtctctccgcctgagctgttctgc | SEQ ID NO: 23 |

TABLE 2-continued

Heavy and light chain sequences of binding proteins. CDR sequences are bolded and italicized.

| | | |
|---|---|---|
| | ctccggctttgatttcgataacgcctggatgacctgggtcaggcagcctccag<br>gtaagggactggagtgggtgggaagaatcacaggtccaggcgagggctgg<br>tccgtggactacgcggaatctgttaaagggcggtttacaatctcaagggacaa<br>taccaagaataccttgtatttggagatgaacaacgtgagaactgaagacaccg<br>gatattacttctgtgccagaacaggcaaatactacgacttctggtccggctatc<br>ccctggcgaggaatattttcaagactggggtcagggaaccccttgttatcgtgt<br>cctccgataagacccacaccgcttccaccaagggcccatcggtcttcccct<br>ggcaccctcctccaagagcacctctgggggcacagcggccctgggctgcct<br>ggtcaaggactacttccccgaaccggtgacggtgtcgtggaactcaggcgc<br>cctgaccagcggcgtgcacaccttcccggctgtcctacagtcctcaggactct<br>actccctcagcagcgtggtgaccgtgccctccagcagcttgggcacccaga<br>cctacatctgcaacgtgaatcacaagcccagcaacaccaaggtggacaaga<br>aagttgagcccaaatcttgtgacaaaactcacacatgcccaccgtgcccagc<br>acctgaactcctggggggaccgtcagtcttcctcttccccccaaaacccaag<br>gacacccctcatgatctcccggacccctgaggtcacatgcgtggtggtggacg<br>tgagccacgaagaccctgaggtcaagttcaactggtatgtggacggcgtgga<br>ggtgcataatgccaagacaaagccgcgggaggagcagtacaacagcacgt<br>accgtgtggtcagcgtcctcaccgtcctgcaccaggactggctgaatggcaa<br>ggagtacaagtgcaaggtctccaacaaagcccctcccagccccatcgagaa<br>aaccatctccaaagccaaagggcagccccgagaaccacaggtgtacaccct<br>gcccccatgccgggatgagctgaccaagaatcaagtcagcctgtggtgcct<br>ggtaaaaggcttctatcccagcgacatcgccgtggagtgggagagcaatgg<br>gcagccggagaacaactacaagaccacgcctcccgtgctggactccgacg<br>gctccttcttcctctactcaaaactcaccgtggacaagagcaggtggcagcag<br>gggaacgtcttctcatgctccgtgctgcatgaggctctgcacagccactacac<br>gcagaagagcctctccctgtctccgggt | |
| Light<br>chain<br>B | gcatccgaactgactcaggaccctgccgtctctgtggcactgaagcagactgtgact<br>attacttgccgaggcgactcactgcggagccactacgcttcctggtatcagaagaaa<br>cccggccaggcacctgtgctgctgttctacggaaagaacaataggccatctggcatc<br>cccgaccgcttttctggcagtgcatcagggaaccgagccagtctgaccattaccggc<br>gccaggctgaggacgaagccgattactattgcagctcccgggataagagcggctc<br>cagactgagcgtgttcggaggaggaactaaactgaccgtcctcgacaaaacccata<br>ccgacttcgtgctgacccagagccctcacagcctgagcgtgacacctggcgagagc<br>gccagcatcagctgcaagagcagccactcccctgatccacggcgaccggaacaact<br>acctggcttggtacgtgcagaagcccggcagatcccccagctgctgatctacctgg<br>ccagcagagccagcggcgtgcccgatagattttctggcagcggcagcgacaa<br>ggacttcacccctgaagatcagccgggtggaaaccgaggacgtgggcacctactact<br>gtatgcagggcagagagagcccctggaccttggccagggcaccaaggtggacat<br>caaggataagacccataccgtacggtggccgctcccagcgtgttcatcttcccacct<br>agcgacgagcagctgaagtccggcacagcctctgtcgtgtgcctgctgaacaacttc<br>tacccccgcgaggccaaagtgcagtggaaggtggacaacgccctgcagagcggc<br>aacagccaggaaagcgtgaccgagcaggacagcaaggactccacctcagcctg<br>agcagcaccctgacactgagcaaggccgactacgagaagcacaaggtgtacgcct<br>gcgaagtgacccaccagggcctgtctagccccgtgaccaagagcttcaaccgggg<br>cgagtgt | SEQ ID<br>NO: 24 |

Binding Protein 4 Amino Acid Sequences

| | | |
|---|---|---|
| Heavy<br>chain<br>A | qvqlvqsggqmkkpgesmriscrasgyefidctlnwirlapgkrpewmgwlk<br>avnyarplqgrvtmtrdvysdtaflelrsltvddtavyfctrgkncdynwdf<br>ehwgrgtpvivssastkgpsvfplapssksstsggtaalgclvkdyfpepvtvswn<br>sgaltsgvhtfpavlqssglyslssvvtvpssslgtqtyicnvnhkpsntkvdkkve<br>pkscdkthtcppcpapellggpsvflfppkpkdtlmisrtpevtcvvvdvshedp<br>evkfnwyvdgvevhnaktkpreeqynstyrvvsvltvlhqdwlngkeykckvs<br>nkalpapiektiskakgqprepqvctlppsrdeltknqvslscavkgfypsdiave<br>wesngqpennykttppvldsdgsfflvskltvdksrwqqgnvfscsvmhealh<br>nhytqkslslspg | SEQ ID<br>NO: 25 |
| Light<br>chain<br>A | Eivltqspgtlslspgetaiiscrtsqygslawyqqrpgqaprlviysgstraagipdr<br>fsgsrwgpdynltisnlesgdfgvyycqqyeffgqgtkvqvdikrtvaapsvfifp<br>psdeqlksgtasvvcllnnfypreakvqwkvdnalqsgnsqesvteqdskdstys<br>lsstltlskadyekhkvyacevthqglsspvtksfnrgec | SEQ ID<br>NO: 26 |
| Heavy<br>chain<br>B | evrlvesgggglvkpggslrlscsasgfdfdnawmtwvrqppgkglewv<br>ngritgpgegwsvdyaesvkgrftisrdntkntlylemnnvrtedtgyyfca<br>rtgkyydfwwgyppgeeyfqdwgqgtlvivssdkthtqvhltqsgpevr<br>kpgtsvkvsckapgntlktydlhwvrsvpgqqlqwmgwishegdkkv<br>iverfkakvtidwdrstntaylqlsgltsgdtavyycakgskhrlrdyalyd<br>ddgalnwavdvdylsnlefwgqgtavtvssdkthtastkgpsvfplapss<br>kstsggtaalgclvkdyfpepvtvswnsgaltsgvhtfpavlqssglysls<br>svvtvpssslgtqtyicnvnhkpsntkvdkkvepkscdkthtcppcpapell<br>ggpsvflfppkpkdtlmisrtpevtcvvvdvshedpevkfnwyvdgve<br>vhnaktkpreeqynstyrvvsvltvlhqdwlngkeykckvsnkalpapie<br>ktiskakgqprepqvytlppcrdeltknqvslwclvkgfypsdiavewes<br>ngqpennykttppvldsdgsfflyskltvdksrwqqgnvfscsvmheal<br>hnhytqkslslspg | SEQ ID<br>NO: 27 |

TABLE 2-continued

Heavy and light chain sequences of binding proteins. CDR sequences are bolded and italicized.

| | | |
|---|---|---|
| Light chain B | tdfvliqsphslsvtpgesasiscksshslihgdrnnylawyvqkpgrspqlhylas rasgvpdrfsgsgsdkdftlkisrvetedvgtyycmqgrespwtfgqgtkvdik dkthtaseltqdpavsvalkqtvtitcrgdslrshyaswyqkkpgqapvllfygkn nrpsgipdrfsgsasgnrasltitgaqaedeadyycssrdksgsrlsvfgggtkltvl dkthtrtvaapsvfifppsdeqlksgtasvvcllnnfypreakvqwkvdnalqsgn sqesvteqdskdstyslsstltlskadyekhkvyacevthqglsspvtksfnrgec | SEQ ID NO: 28 |

Binding Protein 4 Nucleotide Sequences

| | | |
|---|---|---|
| Heavy chain A | caggtgcagctggtgcagtctggcggccagatgaagaaacccggcgagagcatgc ggatcagctgcagagccagcggctacgagttcatcgactgcaccctgaactggatc agactggcccctggcaagcggcctgagtggatgggatggctgaagcctagaggcg gagccgtgaactacgccagacctctgcagggcagagtgaccatgacccgggacgt gtacagcgataccgccttcctggaactgcggagcctgaccgtggatgataccgccgt gtactctgcacccggggcaagaactgcgactacaactgggacttcgagcactggg gcagaggcacccctgtgatcgtgtcaagcgcgtcgaccaagggcccagcgtgttc cctctggccctagcagcaagagcacatctgggcgaacagccgccctgggctgcct cgtgaaggactactttcccgagcccgtgaccgtgtcctggaattctggcgccctgac cagcggcgtgcacacctttccagctgtgctgcagtccagcggcctgtacagcctgag cagcgtcgtgacagtgcccagcagctctctgggcacccagacctacatctgcaacgt gaaccacaagcccagcaacaccaaggtggacaagaaggtggaacccaagagctg cgacaagacccacacctgtcccccctgtcctgccccgaactgctgggaggcccttc cgtgttcctgttccccccaaagcccaaggacaccctgatgatcagccggacccccg aagtgacctgcgtggtggtggatgtgtcccacgaggaccctgaagtgaagttcaatt ggtacgtggacggcgtggaagtgcacaacgccaagaccaagccaagagaggaac agtacaacagcacctaccgggtggtgtccgtgctgaccgtgctgcaccaggactgg ctgaacggcaaagagtacaagtgcaaggtgtccaacaaggccctgcctgcccccat cgagaaaaccatcagcaaggccaagggccagccccgcgaaccccaggtgtgcac actgcccccaagcagggacgagctgaccaagaaccaggtgtccctgagctgtgcc gtgaaaggcttctaccctcccgatatcgccgtggaatgggagggcaacggccagcc cgagaacaactacaagaccacccccctgtgctggacagcgacggctcattcttcct ggtgtccaagctgacagtggacaagtcccggtggcagcagggcaacgtgttcagct gctccgtgatgcacgaggccctgcacaaccactacacccagaagtccctgagcctg agcccggc | SEQ ID NO: 29 |
| Light chain A | Gagatcgtgctgacacagagccctggcacccctgagcctgtctccaggcgagacag ccatcatcagctgccggacaagccagtacggcagcctggcctggtatcagcagag gcctggacaggcccccagactcgtgatctacagcggcagcacaagagccgccgg aatccccgatagattcagcggctccagatggggccctgactacaacctgaccatcag caacctggaaagcggcgacttcggcgtgtactactgccagcagtacgagttcttcgg ccagggcaccaaggtgcaggtggacatcaagcgtacggtggccgctcccagcgtg ttcatcttcccaccctagcgacgagcagctgaagtccggcacagcctctgtcgtgtgcc tgctgaacaacttctaccccgcgaggccaaagtgcagtggaaggtggacaacgcc ctgcagagcggcaacagccaggaaagcgtgaccgagcaggacagcaaggactc cacctacagcctgagcagcaccctgacactgagcaaggccgactacgagaagcac aaggtgtacgcctgcgaagtgacccaccagggcctgtctagccccgtgaccaaga gcttcaaccggggcgagtgt | SEQ ID NO: 30 |
| Heavy chain B | gaggttagactggtggagtcaggagggggcttgtgaagcccggtgggtctctccg cctgagctgactgcctccggctttgatttcgataacgcctggatgacctgggtcaggc agcctccaggtaagggactggagtgggtgggaagaatcacaggtccaggcgagg gctggtccgtggactacgcggaatctgttaaagggcggtttacaatctcaagggaca ataccaagaataccttgtatttggagatgaacaacgtgagaactgaagacaccggat attacttctgtgccagaacaggcaaatactacgacttctggtggggctatcccctgg cgaggaatattttcaagactggggtcagggaaccctgtttatggtgtcctccgacaaa acccataccccaggtgcacctgacacagagcggacccgaagtgcggaagcctggc acctctgtgaaggtgtcctgcaaggcccctggcaacaccctgaaaacctacgacctg cactgggtgcgcagcgtgccaggacagggactgcagtggatgggctggatcagcc acgagggcgacaagaaagtgatcgtggaacggttcaaggccaaagtgaccatcga ctgggacagaagcaccaacaccgcctacctgcagctgagcggcctgacctctggc gataccgccgtgtactactgcgccaagggcagcaagcaccggctgagagactacg ccctgtacgacgatgacggcgcccctgaactgggccgtggatgtggactacctgagc aacctgaattctggggccagggcacagccgtgaccgtgtcatctgataagaccca caccgcttccaccaagggcccatcggtcttcccccctggcaccctcctccaagagcac ctctgggggcacagcggccctgggctgcctggtcaaggactacttccccgaaccgg tgacggtgtcgtggaactcaggcgccctgaccagcggcgtgcacaccttccccggct gtcctacagtcctcaggactctactccctcagcagcgtggtgaccgtgccctccagc agcttgggcacccagacctacatctgcaacgtgaatcacaagcccagcaacaccaa ggtggacaagaaagttgagcccaaatcttgtgacaaaactcacacatgcccaccgtg cccagcacctgaactcctggggggaccgtcagtcttcctcttccccccaaaacccaa ggacaccctcatgatctcccggacccctgaggtcacatgcgtggtggtggacgta gccacgaagacccctgaggtcaagttcaactggtatgttgacggcgtggaggtgcata atgccaagacaaagccgcgggaggagcagtacaacagcacgtaccgtgtggtcag cgtcctcaccgtcctgcaccaggactggctgaatggcaaggagtacaagtgcaagg tctccaacaaagccctcccagcccccatcgagaaaaccatctccaaagccaaaggg cagccccgagaaccacaggtgtacaccctgccccatgccgggatgagctgacca | SEQ ID NO: 31 |

TABLE 2-continued

Heavy and light chain sequences of binding proteins. CDR sequences are bolded and italicized.

| | | |
|---|---|---|
| | agaatcaagtcagcctgtggtgcctggtaaaaggcttctatcccagcgacatcgccgt<br>ggagtgggagagcaatgggcagccggagaacaactacaagaccacgcctcccgt<br>gctggactccgacggctccttcttcctctactcaaaactcaccgtggacaagagcag<br>gtggcagcaggggaacgtcttctcatgctccgtgctgcatgaggctctgcacagcca<br>ctacacgcagaagagcctctccctgtctccgggt | |
| Light<br>chain<br>B | gacttcgtgctgacccagagccctcacagcctgagcgtgacacctggcgagagcg<br>ccagcatcagctgcaagagcagccactccctgatccacggcgaccggaacaacta<br>cctggcttggtacgtgcagaagcccggcagatcccccagctgctgatctacctggc<br>cagcagcagagccagcggcgtgcccgatagattttctggcagcggcagcgacaag<br>gacttcaccctgaagatcagccgggtggaaaccgaggacgtgggcacctactactg<br>tatgcagggcagagagagccccctggacctttggccagggcaccaaggtggacatc<br>aaggacaaaacccataccgcatccgaactgactcaggaccctgccgtctctgtggc<br>actgaagcagactgtgactattacttgccgaggcgactcaatgcgggagccactacgc<br>ttcctggtatcagaagaaacccggccaggcacctgtgctgctgttctacggaaagaa<br>caataggccatctggcatccccgaccgcttttctggcagtgcatcagggaaccgagc<br>cagtctgaccattaccggcgcccaggctgaggacgaagccgattactattgcagctc<br>ccgggataagagcggctccagactgagcgtgttcggaggaggaactaaactgacc<br>gtcctcgataagacccataccgtacggtggccgctcccagcgtgttcatcttcccac<br>ctagcgacgagcagctgaagtccggcacagcctctgtcgtgtgcctgctgaacaact<br>tctaccccgcgaggccaaagtgcagtggaaggtggacaacgccctgcagagcg<br>gcaacagccaggaaagcgtgaccgagcaggacagcaaggactccacctacagcc<br>tgagcagcaccctgacactgagcaaggccgactacgagaagcacaaggtgtacgc<br>ctgcgaagtgacccaccagggcctgtctagccccgtgaccaagagcttcaaccggg<br>gcgagtgt | SEQ ID<br>NO: 32 |

Binding Protein 5 Amino Acid Sequences

| | | |
|---|---|---|
| Heavy<br>chain<br>A | Qvqlvqsggqmkkpgesmriscrasgyefidctlnwirlapgkrpewmgwlk<br>prggavnyarplqgrvtmtrdvysdtaflelrsltvddtavyfctrgkncdynwdf<br>ehwgrgtpvivssastkgpsvfplapsskstsggtaalgclvkdyfpepvtvswns<br>galtsgvhtfpavlqssglyslssvvtvpssslgtqtyicnvnhkpsntkvdkkvep<br>kscdkthtcppcpapellggpsvflfppkpkdtlmisrtpevtcvvvdvshedpe<br>vkfnwyvdgvevhnaktkpreeqynstyrvvsvltvlhqdwlngkeykckvsn<br>kalpapiektiskakgqprepqvctlppsrdeltknqvslscavkgfypsdiavew<br>esngqpennykttppvldsdgsfflvskltvdksrwqqgnvfscsvmhealhnh<br>ytqkslslspg | SEQ ID<br>NO: 33 |
| Light<br>chain<br>A | Eivltqspgtlslspgetaiiscrtsqygslawyqqrpgqaprlviysgstraagipdr<br>fsgsrwgpdynltisnlesgdfgvyycqqyeffgqgtkvqvdikrtvaapsvfifp<br>psdeqlksgtasvvcllnnfypreakvqwkvdnalqsgnsqesvteqdskdstys<br>lsstltlskadyekhkvyacevthqglsspvtksfnrgec | SEQ ID<br>NO: 34 |
| Heavy<br>chain<br>B | Evrlvesggglvkpggslrlscsasgfdfdnawmtwvrqppgkglewv<br>ngritgpgegwsvdyaesykgrftisrdntkntlylemnnvrtedtgyyfcar<br>tgkyydfwwgyppgeeyfqdwgqgtlvivssdkthtqmqlqesgpglv<br>kpsetlsltcsvsgasisdsywswirrspgkglewigyvhksgdtnyspsl<br>ksrvnlsldtsknqvslslvaataadsgkyycartlhgrriygivafnewfty<br>fymdvwgngtqvtvssdkthtastkgpsvfplapssskstsggtaalgclvk<br>dyfpepvtvswnsgaltsgvhtfpavlqssglyslssvvtvpssslgtqtyic<br>nvnhkpsntkvdkkvepkscdkthtcppcpapellggpsvflfppkpkd<br>tlmisrtpevtcvvvdvshedpevkfnwyvdgvevhnaktkpreeqyns<br>tyrvvsvltvlhqdwlngkeykckvsnkalpapiektiskakgqprepqv<br>ytlppcrdeltknqvslwclykgfypsdiavewesngqpennykttppvl<br>dsdgsfflyskltvdksrwqqgnyfscsvmhealhnhytqkslslspg | SEQ ID<br>NO: 35 |
| Light<br>chain<br>B | Sdisvapgetariscgekslgsravqwyqhragqapsliiynnqdrpsgiperfsg<br>nspdspfgttatltitsveagdeadyychiwdsrvptkwvfgggttltvldkthtaselt<br>qdpavsvalkqtvtitcrgdslrshyaswyqkkpgqapvllfygknnrpsgipdrf<br>sgsasgnrasltitgaqaedeadyycssrdksgsrlsvfggtkltvldkthtrtvaap<br>svfifppsdeqlksgtasvvcllnnfypreakvqwkvdnalqsgnsqesvteqds<br>kdstyslsstltlskadyekhkvyacevthqglsspvtksfnrgec | SEQ ID<br>NO: 36 |

Binding Protein 5 Nucleotide Sequences

| | | |
|---|---|---|
| Heavy<br>chain<br>A | Caggtgcagctggtgcagtctggcggccagatgaagaaacccggcgagagcatg<br>cggatcagctgcagagccagcggctacgagttcatcgactgcaccctgaactggat<br>cagactgccctggcaagcggcctgagtggatgggatggctgaagcctagaggc<br>ggagccgtgaactacgccagacctctgcagggcagagtgaccatgacccgggac<br>gtgtacagcgataccgccttcctggaactgcggagcctgaccgtggatgataccgcc<br>gtgtacttctgcacccggggcaagaactgcgactacaactgggacttcgagcactgg<br>ggcagaggcaccccctgtgatcgtgtcaagc<br>gcgtcgaccaagggcccagcgtgttccctctggccccagcagcaagagcacatc<br>tggcggaacagccgccctgggctgcctcgtcaaggactacttcccgagccgtga<br>ccgtgtcctggaattctggcgccctgaccagcggcgtgcacacctttccagctgtgct<br>gcagtccagcggcctgtacagcctgagcagcgtcgtgacagtgcccagcagctctc<br>tgggcacccagacctacatctgcaacgtgaaccacaagcccagcaacaccaaggt | SEQ ID<br>NO: 37 |

TABLE 2-continued

Heavy and light chain sequences of binding proteins. CDR sequences are bolded and italicized.

| | | |
|---|---|---|
| | ggacaagaaggtggaacccaagagctgcgacaagacccacacctgtcccccttgt cctgcccccgaactgctgggaggcccttccgtgttcctgttcccccccaaagcccaag gacaccctgatgatcagccggacccccgaagtgacctgcgtggtggtggatgtgtc ccacgaggaccctgaagtgaagttcaattggtacgtggacggcgtggaagtgcaca acgccaagaccaagccaagagaggaacagtacaacagcacctaccgggtggtgtc cgtgctgaccgtgctgcaccaggactggctgaacggcaaagagtacaagtgcaag gtgtccaacaaggccctgcctgcccccatcgagaaaaccatcagcaaggccaagg gccagccccgcgaaccccaggtgtgcacactgcccccaagcagggacgagctga ccaagaaccaggtgtccctgagctgtgccgtgaaaggcttctacccctccgatatcg ccgtggaatgggagagcaacggccagcccgagaacaactacaagaccacccccc ctgtgctggacagcgacggctcattcttcctggtgtccaagctgacagtggacaagtc ccggtggcagcagggcaacgtgttcagctgctccgtgatgcacgaggccctgcaca accactacacccagaagtccctgagcctgagcccggc | |
| LightGa chainc cat catcagctgccggacaagccagtacggcagcctggcctggtatcagcagag A | gatcgtgctgacacagagccctggcaccctgagcctgtctccaggcgagacag gcctggacaggccccagactcgtgatctacagcggcagcacaagagccgcgg aatccccgatagattcagcggctccagatggggccctgactacaacctgaccatcag caacctggaaagcggcgacttcggcgtgtactactgccagcagtacgagttcttcgg ccagggcaccaaggtgcaggtggacatcaagcgtacggtggccgctcccagcgtg ttcatcttcccacctagcgacgagcagctgaagtccggcacagcctctgtcgtgtgcc tgctgaacaacttctacccccgcgaggccaaagtgcagtggaaggtggacaacgcc ctgcagagcggcaacagccaggaaagcgtgaccgagcaggacagcaaggactc cacctacagcctgagcagcaccctgacactgagcaaggccgactacgagaagcac aaggtgtacgcctgcgaagtgacccaccagggcctgtctagccccgtgaccaaga gcttcaaccggggcgagtgt | SEQ ID NO: 38 |
| Heavy chainc B | gaggttagactggtggagtcaggagggggcttgtgaagcccggtgggtctctccg cctgagctgactgcctccggctttgatttcgataacgcctggatgacctgggtcaggc agcctccaggtaagggactggagtgggtgggaagaatcacaggtccaggcgagg gctggtccgtggactacgcggaatctgttaaaggcggtttacaatctcaagggaca ataccaagaataccttgtatttggagatgaacaacgtgagaactgaagacaccggat attacttctgtgccagaacaggcaaatactacgacttctggtggggctatcccctgg cgaggaatattttcaagactgggtgtcagggaacccttgttatcgtgtcctccgacaaa acccataccagatgcagctgcaggagagcggccctggactcgtgaagcccagcg agaccctgagcctgacatgcagcgtgagcggcgccagcatcagcgacagctactg gagctggatcaggaggagccctggcaagggcctggagtggatcggctacgtgcac aagagcggcgacaccaactacagccctcctgaagtccagggtgaacctgtccct ggacaccagcaagaaccaggtgagcctgtcctggtggctgccacagctgctgac agcggcaagtactactgtgccaggaccctgcacggcaggaggatctacggcatcgt ggccttcaacgagtggttcacctacttctacatggacgtgtggggcaacggcaccca ggtgaccgtgagctccgataagacccacaccgcttccaccaagggcccatcggtctt cccccctggcaccctcctccaagagcacctctggggcacagcggccctgggctgc ctggtcaaggactacttccccgaaccggtgacggtgtcgtggaactcaggcgccct gaccagcggcgtgcacaccttcccggctgtcctacagtcctcaggactctactccctc agcagcgtggtgaccgtgccctccagcagcttgggcacccagacctacatctgcaa cgtgaatcacaagcccagcaacaccaaggtggacaagaaagttgagcccaaatctt gtgacaaaactcacacatgcccaccgtgcccagcacctgaactcctggggggacc gtcagtcttcctcttccccccaaaacccaaggacaccctcatgatctcccggacccct gaggtcacatgcgtggtggtggacgtgagccacgaagaccctgaggtcaagttcaa ctggtatgttgacggcgtggaggtgcataatgccaagacaaaagccgcggaggag cagtacaacagcacgtaccgtgtggtcagcgtcctcaccgtcctgcaccaggactg gctgaatggcaaggagtacaagtgcaaggtctccaacaaagcccccagcccca tcgagaaaaccatctccaaagccaaagggcagccccgagaaccacaggtgtacac cctgcccccatgccgggatgagctgaccaagaatcaagtcagcctgtggtgcctggt aaaaggcttctatcccagcgacatcgccgtggagtgggagagcaatgggcagccg gagaacaactacaagaccacgcctcccgtgctggactccgacggctccttcttcctct actaaaactcaccgtggacaagagcaggtggcagcaggggaacgtcttctcatgc tccgtgatgcatgaggctctgcacaaccactacacgcagaagagcctctccctgtctc cgggt | SEQ ID NO: 39 |
| Lightt chaing B | tccgacatcagcgtggcccccggagagacagccaggatctcctgcggcgagaaga gcctgggaagcagggctgtgcagtggtaccaacacagggccggacaggctccca gcctgatcatctacaacaaccaggacaggcccagcggcatccctgagaggttcagc ggaagccccgacagcccttcggaaccacagccaccctgaccatcacaagcgtgg aagccggcgacgaggccgactactactgccacatctgggacagcagggtgcccac caagtgggtgtttggcggcggcaccaccctgaccgtgctggacaaaacccataccg catccgaactgactcaggacccctgccgtctctgtggcactgaagcagctgtgactat tacttgccgaggcgactcactgcggagccactacgcttcctggtatcagaagaaacc cggccaggcacctgtgctgctgttctacggaaagaacaataggccatctggcatccc cgaccgcttttctggcagtgcatcagggaaccgagccagtctgaccattaccggcgc ccaggctgaggacgaagccgattactattgcagctcccgggataagagcggctcca gactgagcgtgttcggaggaggaactaaactgaccgtcctcgataagacccatacc cgtacggtggccgctcccagcgtgttcatcttcccacctagcgacgagcagctgaag tccggcacagcctctgtcgtgtgcctgctgaacaacttctacccccgcgaggccaaa gtgcagtggaaggtggacaacgccctgcagagcggcaacagccaggaaagcgtg accgagcaggacagcaaggactccacctacagcctgagcagcaccctgacactga | SEQ ID NO: 40 |

| | | |
|---|---|---|
| | gcaaggccgactacgagaagcacaaggtgtacgcctgcgaagtgacccaccagg gcctgtctagccccgtgaccaagagcttcaaccggggcgagtgt | |
| Binding Protein 6 Amino Acid Sequences | | |
| Heavy chain A | Qvqlvqsggqmkkpgesmriscrasgyefidctlnwirlapgkrpewmgwlk prggavnyarplqgrvtmtrdvysdtafleirsltvddtavyfctrgkncdynwdf ehwgrgtpvivssastkgpsvfplapsskstsggtaalgclvkdyfpepvtswns galtsgvhtfpavlqssglyslssvvtvpssslgtqtyicnvnhkpsntkvdkkvep kscdkthtcppcpapellggpsvflfppkpkdtlmisrtpevtcvvvdvshedpe vkfnwyvdgvevhnaktkpreeqynstyrvvsvltvlhqdwlngkeykckvsn kalpapiektiskakgqprepqvctlppsrdeltknqvslscavkgfypsdiavew esngqpennykttppvldsdgsfflvskltvdksrwqqgnvfscsvmhealhnh ytqkslslspg | SEQ ID NO: 41 |
| Light chain A | Eivltqspgtlslspgetaiiscrtsqygslawyqqrpgqaprlviysgstraagipdr fsgsrwgpdynltisnlesgdfgvyycqqyeffgqgtkvqvdikrtvaapsvfifp psdeqlksgtasvvcllnnfypreakvqwkvdnalqsgnsqesvteqdskdstys lsstltlskadyekhkvyacevthqglsspvtksfnrgec | SEQ ID NO: 42 |
| Heavy chain B | Qvhltqsgpevrkpgtsvkvsckapgntlktydlhwvrsvpgqglqwm gwishegdkkviverfkakvtidwdrstntaylqlsgltsgdtavyycakg skhrlrdyalydddgalnwavdvdylsnlefwgqgtavtvssdkthtevrl vesggglvkpggslrlscsasgfdfdnawmtwvrqppgkglewvgritg pgegwsvdyaesvkgrftisrdntkntlylemnnvrtedtgyyfcartgky ydfwwgyppgeeyfqdwgqgtlvivssdkthtastkgpsvfplapsskst sggtaalgclvkdyfpepvtswnsgaltsgvhtfpavlqssglyslssvvt vpssslgtqtyicnvnhkpsntkvdkkvepkscdkthtcppcpapellgg psvflfppkpkdtlmisrtpevtcvvvdvshedpevkfnwyvdgvevhn aktkpreeqynstyrvvsvltvlhqdwlngkeykckvsnkalpapiektis kakgqprepqvytlppcrdeltknqvslwclvkgfypsdiavewesngq pennykttppvldsdgsfflyskltvdksrwqqgnvfscsvmhealhnhy tqkslslspg | SEQ ID NO: 43 |
| Light chain B | Aseltqdpavsvalkqtvtitcrgdslrshyaswyqkkpgqapvllfygknnrps gipdrfsgsasgnrasltitgaqaedeadyycssrdksgsrlsvfgggtkltvldktht dfvltqsphslsvtpgesasisckshslihgdrnnylawyvqkpgrspqlliylass rasgvpdrfsgsgsdkdftlkisrvetedvgtyycmqgrespwtfgqgtkvdikd kthtrtvaapsvfifppsdeqlksgtasvvcllnnfypreakvqwkvdnalqsgns qesvteqdskdstyslsstltlskadyekhkvyacevthqglsspvtksfnrgec | SEQ ID NO: 44 |
| Binding Protein 6 Nucleotide Sequences | | |
| Heavy chain A | caggtgcagctggtgcagtctggcggccagatgaagaaacccggcgagagcatgc ggatcagctgcagagccagcggctacgagttcatcgactgcaccctgaactggatc agactggcccctggcaagcggcctgagtggatgggatggctgaagcctagaggcg gagccgtgaactacgccagacctctgcagggcagagtgaccatgacccgggacgt gtacagcgataccgccttcctggaactgcggagcctgaccgtggatgataccgccgt gtacttctgcacccggggcaagaactgcgactacaactgggacttcgagcactggg gcagaggcacccctgtgatcgtgtcaagcgcgtcgaccaagggcccagcgtgttc cctctggccccttagcagcaagagcacatctggcggaacagccgccctgggctgcct cgtgaaggactactaccccgagcccgtgaccgtgtcctggaattctggcgcgcctgac cagcggcgtgcacacctttccagctgtgctgcagtccagcggcctgtacagcctgag cagcgtcgtgacagtgcccagcagctctctgggcacccagacctacatctgcaacgt gaaccacaagcccagcaacaccaaggtggacaagaaggtggaacccaagagctg cgacaagacccacacctgtccccccttgtcctgcccccgaactgctggaggcccttc cgtgttcctgttccccccaaagcccaaggacaccctgatgatcagccggacccccg aagtgacctgcgtggtggtggatgtgtcccacgaggaccctgaagtgaagttcaatt ggtacgtggacggcgtggaagtgcacaacgccaagaccaagccaagagaggaac agtacaacagcacctaccgggtggtgtccgtgctgaccgtgctgcaccaggactgg ctgaacggcaaagagtacaagtgcaaggtgtccaacaaggccctgcctgccccat cgagaaaaccatcagcaaggccaagggccagccccgcgaaccccaggtgtgcac actgccccaagcagggacgagctgaccaagaaccaggtgtccctgagctgtgcc gtgaaaggcttctacccctccgatatcgccgtggaatgggagagcaacggccagcc cgagaacaactacaagaccacccccctgtgctggacagcgacggctcattcttcct ggtgtccaagctgacagtggacaagtcccggtggcagcagggcaacgtgttcagct gctccgtgatgcacgaggccctgcacaaccactacacccagaagtccctgagcctg agccccggc | SEQ ID NO: 45 |
| Light chain A | gagatcgtgctgacacagagccctggcaccctgagcctgtctccaggcgagacag ccatcatcagctgccggacaagccagtacggcagcctggcctggtatcagcagag gcctggacaggccccccagactcgtgatctacagcggcagcacaagagccgccgg aatccccgatagattcagcggctccagatggggccctgactacaacctgaccatcag caacctggaaagcggcgacttcggcgtgtactactgccagcagtacgagttcttcgg ccagggcaccaaggtgcaggtggacatcaagcgtacggtggccgctcccagcgtg ttcatcttcccacctagcgacgagcagctgaagtccggcacagcctctgtcgtgtgcc tgctgaacaacttctacccccgcgaggccaaagtgcagtggaaggtggacaacgcc | SEQ ID NO: 46 |

TABLE 2-continued

Heavy and light chain sequences of binding proteins. CDR sequences are bolded and italicized.

| | | |
|---|---|---|
| | ctgcagagcggcaacagccaggaaagcgtgaccgagcaggacagcaaggactc cacctacagcctgagcagcaccctgacactgagcaaggccgactacgagaagcac aaggtgtacgcctgcgaagtgacccaccagggcctgtctagccccgtgaccaaga gcttcaaccggggcgagtgt | |
| Heavy chain B | caggtgcacctgacacagagcggacccgaagtgcggaagcctggcacctctgtga aggtgtcctgcaaggcccctggcaacaccctgaaaacctacgacctgcactgggtg cgcagcgtgccaggacagggactgcagtggatgggctggatcagccacgagggc gacaagaaagtgatcgtggaacggttcaaggccaaagtgaccatcgactgggaca gaagcaccaacaccgcctacctgcagctgagcggcctgacctctggcgataccgc cgtgtactactgcgccaagggcagcaagaccggctgagagactacgccctgtac gacgatgacggcgccctgaactgggccgtggatgtggactacctgagcaacctgg aattctggggccagggcacagccgtgaccgtgtcatctgacaaaacccataccgag gttagactggtggagtcaggagggggcttgtgaagcccgtgggtctctccgcct gagctgttctgcctccggcttttgatttcgataacgcctggatgacctgggtcaggcag cctccaggtaagggactggagtgggtgggaagaatcacaggtccaggcgagggct ggtccgtggactacgcggaatctgttaaagggcggtttacaatctcaagggacaata ccaagaatacctigtatttggagataacaacgtgagaactgaagacaccggatatta cttctgtgccagaacaggcaaatactacgacttctggtgggctatccccctggcga ggaatatttcaagactggggtcagggaacccttgttatcgtgtcctccgataagaccc acaccgcttccaccaagggcccatcggtcttccccctggcacctcctccaagagca cctctggggcacagcggccctgggctgcctggtcaaggactacttccccgaaccg gtgacggtgtcgtggaactcaggcgccctgaccagcggcgtgcacaccttcccggc tgtcctacagtcctcaggactctactccctcagcagcgtggtgaccgtgccctccagc agcttgggcacccagacctacatctgcaacgtgaatcacaagcccagcaacaccaa ggtggacaagaaagttgagcccaaatcttgtgacaaaactcacacatgcccaccgtg cccagcacctgaactcctggggggaccgtcagtcttcctcttccccccaaaacccaa ggacaccctcatgatctcccggacccctgaggtcacatgcgtggtggtggacgtga gccacgaagaccctgaggtcaaghcaactggtatgttgacggcgtggaggtgcata atgccaagacaaagccgcgggaggagcagtacaacagcacgtaccgtgtggtcag cgtcctcaccgtcctgcaccaggactggctgaatggcaaggagtacaagtgcaagg tctccaacaaagccctcccagcccccatcgagaaaaccatctccaaagccaaaggg cagccccgagaaccacaggtgtacaccctgcccccatgccgggatgagctgacca gaatcaagtcagcctgtggtgcctggtaaaaaggcttctatcccagcgacatcgccgt ggagtgggagagcaatgggcagccggagaacaactacaagaccacgcctcccgt gctggactccgacggctccttcttcctctactccaaaactcaccgtggacaagagcag gtggcagcaggggaacgtcttctcatgctccgtgatgcatgaggctctgcacaacca ctacacgcagaagagcctctccctgtctccgggt | SEQ ID NO: 47 |
| Light chain B | Gcatccgaactgactcaggaccctgccgtctctgtggcactgaagcagact tgactattacttgccgaggcgactcactgcggagccactacgcttcctggta tcagaagaaacccggccaggcacctgtgctgctgttctacggaaagaacaat aggccatctggcatccccgaccgcttttctggcagtgcatcagggaaccgag ccagtctgaccattaccggcgcccaggctgaggacgaagccgattactattg cagctcccgggataagagcggctccagactgagcgtgttcggaggaggaa ctaaactgaccgtcctcgacaaaacccataccgacttcgtgctgacccagag ccctcacagcctgagcgtgacacctggcgagagcgccagcatcagctgca agagcagccactccctgatccacggcgaccggaacaactacctggcttggt acgtgcagaagcccggcagatcccccagctgctgatctacctggccagca gcagagccagcggcgtgcccgatagattctctggcagcggcagcgacaag gacttcaccctgaagatcagccgggtggaaaccgaggacgtgggcacctac tactgtatgcagggcagagagagcccctggacctttggccagggcaccaag gtggacatcaaggataagacccataccgcggtggccgctcccagcgtg ttcatcttcccacctagcgacgagcagctgaagtccggcacagcctctgtcgt gtgcctgctgaacaacttctacccccgcgaggccaaagtgcagtggaaggt ggacaacgccctgcagagcggcaacagccaggaaagcgtgaccgagcag gacagcaaggactccacctacagcctgagcagcaccctgacactgagcaa ggccgactacgagaagcacaaggtgtacgcctgcgaagtgacccaccagg gcctgtctagccccgtgaccaagagcttcaaccggggcgagtgt | SEQ ID NO: 48 |

Binding Protein 7 Amino Acid Sequences

| | | |
|---|---|---|
| Heavy chain A | Qvqlvqsggqmkkpgesmriscrasgyefidctlnwirlapgkrpewmgwlk dvnprggavnyarplqgrvtmtrdvysdtaflelrsltvddtavyfctrgkncdynwdf ehwgrgtpvivssastkgpsvflplapssktsggtaalgclvkdyfpepvtvswns galtsgvhtfpavlqssglyslssvvtvpssslgtqtyicnvnhkpsntkvdkkvep kscdkthtcppcpapellggpsvflfppkpkdtlmisrtpevtcvvvdvshedpe vkfnwyvdgvevhnaktkpreeqynstyrvvsvltvlhqdwlngkeykckvsn kalpapiektiskakgqprepqvctlppsrdeltknqvslscavkgfypsdiavew esngqpennykttppvldsdgsfflvskitvdksrwqqgnvfscsvmhealhnh ytqkslslspg | SEQ ID NO: 49 |
| Light chain A | Eivltqspgtlslspgetaiiscrtsqygslawyqqrpgqaprlviysgstraagipdr fsgsrwgpdynltisnlesgdfgvyycqgyeffgqgtkvqvdikrtvaapsvfifp psdeqlksgtasvvcllnnfypreakvqwkvdnalqsgnsqesvteqdskdstys lsstltlskadyekhkvyacevthqglsspvtksfnrgec | SEQ ID NO: 50 |

TABLE 2-continued

Heavy and light chain sequences of binding proteins. CDR sequences are bolded and italicized.

| | | |
|---|---|---|
| Heavy chain B | yqmqlqesgpglvkpsetlsltcsvsgasisdsywswirrspgkglewigy invhksgdtnyspslksrvnlsldtsknqvslslvaataadsgkyycartlhgrr iygivafnewftyfymdvwgngtqvtvssdkthtQvhltqsgpevrkpgtsvkvsckapgntlktydlhwvrsvpgqglqwmgwishegdkkviverfkakvtidwdrstntaylqlsgltsgdtavyycakgskhrlrdyalydddgalnwavdvdylsnlefwgqgtavtvssdkthtastkgpsvfplapssksts ggtaalgclvkdyfpepvtvswnsgaltsgvhtfpavlqssglyslssvvtvpssslgtqtyicnvnhkpsntkvdkkvepkscdkthtcppcpapellggpsvflfppkpkdtlmisrtpevtcvvvdvshedpevkfnwyvdgvevhnaktkpreeqynstyrvvsvltvlhqdwlngkeykckvsnkalpapiektisk akgqprepqvytlppcrdeltknqvslwclvkgfypsdiavewesngqpennykttppvldsdgsfflyskltvdksrwqqgnvfscsvmhealhnhytqkslslspg | SEQ ID NO: 51 |
| Light chain B | Dfvltqsphslsvtpgesasiscksshslihgdrnnylawyvqkpgrspqlliylas srasgvpdrfsgsgsdkdftlkisrvetedvgtyycmqgrespwtfgqgtkvdik dkthtsdisvapgetariscgekslgsravqwyqhragqapsliiynnqdrpsgiperfsgspdspfgttatltitsveagdeadyychiwdsrvptkwvfgggaltvldkthtrtvaapsvfifppsdeqlksgtasvvcllnnfypreakvqwkvdnalqsgnsqesvteqdskdstyslsstltlskadyekhkvyacevthqglsspvtksfnrgec | SEQ ID NO: 52 |

Binding Protein 7 Nucleotide Sequences

| | | |
|---|---|---|
| Heavy chain A | caggtgcagctggtgcagtctggcggccagatgaagaaacccggcgagagcatgc ggatcagctgcagagccagcggctacgagttcatcgactgcaccctgaactggatc agactggccccctggcaagcggcctgagtggatgggatggctgaagcctagaggcg gagccgtgaactacgccagacctctgcagggcagagtgaccatgaccgggacgt gtacagcgataccgccttcctggaactgcggagcctgaccgtggatgataccgccgt gtactctgcacccggggcaagaactgcgactacaactgggacttcgagcactggg gcagaggcaccctgtgatcgtgtcaagcgcgtcgaccaagggcccagcgtgttcc ctctggccctagcagcaagagcacatctggcggaacagcgcctggctgcctcgtg aaggactactttcccgagcccgtgaccgtgtcctggaattctggcgccctgaccagcggcgtgcacacccttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgaaccccaggtgtgcacactgccccccaagcagggacgagctgaccaagaaccaggtgtccctgagctgtgccgtgaaaggcttctaccccctccgatatcgccgtgaatgggagagcaacggccagccgagaacaactacaagaccacccccctgtgctggacagcgacggctcattcttcctggtgtccaagctgacagtggacaagtcccggtggcagcagggcaacgtgttcagctgctccgtgatgcacgaggccctgcacaaccactacacccagaagtccctgagcctgagccccggc | SEQ ID NO: 53 |
| Light chain A | gagatcgtgctgacacagagccctggcaccctgagcctgtctccaggcgagacag ccatcatcagctgccggacaagccagtacggcagcctggcctggtatcagcagag gcctggacaggcccccagactcgtgatctacagcggcagcacaagagccgccg aatcccccgatagattcagcggctccagatggggccctgactacaacctgaccatcag caacctggaaagcggcgacttcggcgtgtactactgccagcagtacgagttcttcgg ccagggcaccaaggtgcaggtggacatcaagcgtacggtggccgctcccagcgtg ttcatcaccccacctagcgacgagcagctgaagtccggcacagcctctgtcgtgtgc tgctgaacaacttctacccccgcgaggccaaagtgcagtggaaggtggacaacgcc ctgcagagcggcaacagccaggaaagcgtgaccgagcaggacagcaaggactc cacctacagcctgagcagcaccctgacactgagcaaggccgactacgagaagcac aaggtgtacgcctgcgaagtgacccaccagggcctgtctagccccgtgaccaaga gcttcaaccggggcgagtgt | SEQ ID NO: 54 |
| Heavy chain B | cagatgcagctgcaggagagcggccctggactcgtgaagcccagcgagaccctg agcctgacatgcagcgtgagcggcgccagcatcagcgacagctactggagctgga tcaggaggagccctggcaagggcctggagtggatcggctacgtgcacaagagcg gcgacaccaactacagcccctccctgaagtccagggtgaacctgtccctggacacc agcaagaaccaggtgagcctgtccctggtggctgccacagctgctgacagcggca gtactactgtgccaggaccctgcacggcagaggatctacagcatcgtggccttca acgagtggttcaccttattctacatggacgtgtggggcaacggcacccaggtgacc gtgagctccgacaaaacccataccacaggtgcacctgacacagagcggaccccgaag tgcggaagcctggcacctctgtgaaggtgtcctgcaaggccctggcaacaccctg aaaacctacgacctgcactgggtgcgcagcgtgccaggacagggactgcagtgga tgggcatcagccacgagggcgacaagaaagtgatcgtggaacggttcaaggccaaagtgaccatcgactgggacagaagcaccaacaccgcctacctgcagctgagc ggcctgacctctggcgataccgccgtgtactactgcgccaagggcagcaagcacc ggctgagagactacgccctgtacgacgatgacggcgccctgaactgggccgtggatgtggactacctgagcaacctggaattctgggccagggcacagccgtgaccgtgt | SEQ ID NO: 55 |

TABLE 2-continued

Heavy and light chain sequences of binding proteins. CDR sequences are bolded and italicized.

| | | |
|---|---|---|
| | catctgataagacccacaccgcttccaccaagggcccatcggtcttcccccctggcac<br>cctcctccaagagcacctctgggggcacagcggccctgggctgcctggtcaagga<br>ctacttccccgaaccggtgacggtgtcgtggaactcaggcgccctgaccagcggcg<br>tgcacaccttcccggctgtcctacagtcctcaggactctactccctcagcagcgtggt<br>gaccgtgccctccagcagcttgggcacccagacctacatctgcaacgtgaatcaca<br>agcccagcaacaccaaggtggacaagaaagttgagcccaaatcttgtgacaaaact<br>cacacatgcccaccgtgcccagcacctgaactcctggggggaccgtcagtcttcctc<br>ttccccccaaaacccaaggacaccctcatgatctcccggacccctgaggtcacatgc<br>gtggtggtggacgtgagccacgaagaccctgaggtcaagttcaactggtatgttgac<br>ggcgtggaggtgcataatgccaagacaaagccgcggggaggagcagtacaacagc<br>acgtaccgtgtggtcagcgtcctcaccgtcctgcaccaggactggctgaatggcaag<br>gagtacaagtgcaaggtctccaacaaagccctcccagcccccatcgagaaaaccat<br>ctccaaagccaaagggcagccccgagaaccacaggtgtacaccctgcccccatgc<br>cgggatgagctgaccaagaatcaagtcagcctgtggtgcctggtaaaaggcttctat<br>cccagcgacatcgccgtggagtgggagagcaatgggcagccggagaacaactac<br>aagaccacgcctcccgtgctggactccgacggctccttcttcctctactcaaaactca<br>ccgtggacaagagcaggtggcagcaggggaacgtcttctcatgctccgtgatgcat<br>gaggctctgcacaaccactacacgcagaagagcctctccctgtctccgggt | |
| LightGacttcgtgctgacccagagccctcacagcctgagcgtgacacctggcgag<br>chainagcgccagcatcagctgcaagagcagccactccctgatccacggcgaccg<br>B      gaacaactacctggcttggtacgtgcagaagcccggcagatcccccagct<br>gctgatctacctggccagcagcagagccagcggcgtgcccgatagatttct<br>ggcagcggcagcggcagcggggacaaggacttcaccctgaagatcagccgggtggaaac<br>cgaggacgtgggcacctactactgtatgcagggcagagagagcccctgga<br>cctttggccagggcaccaaggtggacatcaaggacaaaaccatacctccg<br>acatcagcgtggcccccggagagagacagccaggatctcctgcggcgagaag<br>agcctgggaagcagggctgtgcagtggtaccaacacagggccggacagg<br>ctcccagcctgatcatctacaacaaccaggacaggcccagcggcatccctg<br>agaggttcagcggaagcccccgacagccccttcggaaccacagccaccctg<br>accatcacaagcgtggaagccggcgacgaggccgactactactgccacatc<br>tgggacagcagggtgcccaccaagtgggtgtttggcggcggcaccaccct<br>gaccgtgctggataagacccataccgtacggtggccgctcccagcgtgttc<br>atcttcccacctagcgacgagcagctgaagtccggcacagcctctgtcgtgt<br>gcctgctgaacaacttctaccccgcgaggccaaagtgcagtggaaggtgg<br>acaacgccctgcagagcggcaacagccaggaaagcgtgaccgagcagga<br>cagcaaggactccacctacagcctgagcagcaccctgacactgagcaagg<br>ccgactacgagaagcacaaggtgtacgcctgcgaagtgacccaccagggc<br>ctgtctagccccgtgaccaagagcttcaaccggggcgagtgt | SEQ ID<br>NO: 56 |

Binding Protein 8 Amino Acid Sequences

| | | |
|---|---|---|
| HeavyRahlvqsgtamkkpgasvrvscqtsgytftahilfwfrqapgrglewvgwikpq<br>chainygavnfgggfrdrvtltrdvyreiaymdirglkpddtavyycardrsygdsswal<br>A      dawgqgttvvvsaastkgpsvfplapssksstsggtaalgclvkdyfpepvtvswn<br>sgaltsgvhtfpavlqssglyslssvvtvpssslgtqtyicnvnhkpsntkvdkkve<br>pkscdkthtcppcpapellggpsvflfppkpkdtlmisrtpevtcvvvdvshedp<br>evkfnwyvdgvevhnaktkpreeqynstyrvvsvltvlhqdwlngkeykckvs<br>nkalpapiektiskakgqprepqvctlppsrdeltknqvslscavkgfypsdiave<br>wesngqpennykttppvldsdgsffflvskltvdksrwqqgnvfscsvlhealhsh<br>ytqkslslspg | SEQ ID<br>NO: 57 |
| LightYihvtqspsslsvsigdrvtincqtsqgvgsdlhwyqhkpgrapkllihhtssved<br>chaingvpsrfsgsgfhtsfnltisdlqaddiatyycqvlqffgrgsrlhikrtvaapsvfifpp<br>A      sdeqlksgtasvvcllnnfypreakvqwkvdnalqsgnsqesvteqdskdstysl<br>sstltlskadyekhkvyacevthqglsspvtksfnrgec | SEQ ID<br>NO: 58 |
| HeavyEvrlvesgggglvkpggslrlscsasgfdfdnawmtwvrqppgkglewv<br>chaingritgpgegwsvdyaesykgrftisrdntkntlylemnnvrtedtgyyfcar<br>B      tgkyydfwwgyppgeeyfqdwgqgtlvivssdkthtqvqlvesgggvv<br>qpgtslrlscaasqfrfdgygmhwvrqapgkglewvasishdgikkyha<br>ekvwgrftisrdnskntlylqmnslrpedtalyycakdlredeceewwsd<br>yydfgkqlpcaksrgglygiadnwgqgtmvtvssdkthtastkgpsvfpl<br>apssksttsggtaalgclvkdyfpepvtvswnsgaltsgvhtfpavlqssgly<br>slssvvtvpssslgtqtyicnvnhkpsntkvdkkvepkscdkthtcppcpa<br>pellggpsvflfppkpkdtlmisrtpevtcvvvdvshedpevkfnwyvd<br>gvevhnaktkpreeqynstyrvvsvltvlhqdwlngkeykckvsnkalp<br>apiektiskakgqprepqvytlppcrdeltknqvslwclvkgfypsdiave<br>wesngqpennykttppvldsdgsffflyskltvdksrwqqgnyfscsvmh<br>ealhnhytqkslslspg | SEQ ID<br>NO: 59 |
| LightQsvltqppsvsaapgqkvtiscsgntsnignnfvswyqqrpgrapqllliyetdkr<br>chainpsgipdrfsasksgtsgtlaitglqtgdeadyycatwaaslssarvfgtgtkvivldkt<br>B      htaseltqdpavsvalkqtvtitcrgdslrshyaswyqkkpgqapvllfygknnrp<br>sgipdrfsgsasgnrasititgaqaedeadyycssrdksgsrlsvfgggtkltvldkt<br>htrtvaapsvfifppsdeqlksgtasvvcllnnfypreakvqwkvdnalqsgnsqe<br>svteqdskdstyslsstltlskadyekhkvyacevthqglsspvtksfnrgec | SEQ ID<br>NO: 60 |

TABLE 2-continued

Heavy and light chain sequences of binding proteins. CDR sequences are bolded and italicized.

Binding Protein 8 Nucleotide Sequences

| | | |
|---|---|---|
| Heavy chain A | agagcccacctggtgcagtctggcaccgccatgaagaaaccaggcgcctctgtgc<br>ggtgtcctgtcagacaagcggctacaccttcaccgcccacatcctgttctggaccg<br>gcaggcccctggcagaggactggaatgggtgggatggatcaagcccagtatggc<br>gccgtgaacttcggcggaggcttccgggatagagtgacccgtgacccgggacgtgt<br>accgcgagatcgcctacatggacatccggggcctgaagcccgatgacaccgccgt<br>gtactactgcgccagagacagaagctacggcgacagcagctgggctctggatgctt<br>ggggccagggcacaaccgtggtggtgtctgccgcctctacaaaggggcccagcgt<br>gttccctctggcccctagcagcaagagcacatctggcggaacagccgccctgggct<br>gcctcgtgaaggactactttcccgagcccgtgaccgtgtcctggaattctggcgccct<br>gaccagcggcgtgcacacctttccagctgtgctgcagtccagcggcctgtacagcc<br>tgagcagcgtcgtgacagtgcccagcagctctctgggcacccagacctacatctgc<br>aacgtgaaccacaagcccagcaacaccaaggtggacaagaaggtggaacccaag<br>agctgcgacaagacccacacctgtcccccttgtcctgcccccgaactgctgggagg<br>cccttccgtgttcctgttccccccaaagcccaaggacaccctgatgatcagccggac<br>ccccgaagtgacctgcgtggtggtggatgtgtcccacgaggaccctgaagtgaagt<br>tcaattggtacgtggacggcgtggaagtgcacaacgccaagaccaagccaagaga<br>ggaacagtacaacagcacctaccgggtggtgtccgtgctgaccgtgctgcaccag<br>gactggctgaacggcaaagagtacaagtgcaaggtgtccaacaaggccctgcctg<br>cccccatcgagaaaaccatcagcaaggccaagggccagccccgcgaacccag<br>gtgtgcacactgccccaagcagggacgagctgaccaagaaccaggtgtccctga<br>gctgtgccgtgaaaggcttctacccctccgatatcgccgtggaatgggagagcaac<br>ggccagcccgagaacaactacaagaccacccccctgtgctggacagcgacggc<br>tcattcttcctggtgtccaagctgacagtggacaagtcccggtggcagcagggcaac<br>gtgttcagctgctccgtgatgcacgaggccctgcacaaccactacacccagaagtc<br>cctgagcctgagccccggcaag | SEQ ID<br>NO: 61 |
| Light chain A | acatccacgtgacccagagccccagcagcctgtccgtgtccatcggcgac<br>agagtgaccatcaactgccagacctctcagggcgtgggcagcgacctgcac<br>tggtatcagcacaagcctggcagagccccaagctgctgatccaccacaca<br>agcagcgtggaagatggcgtgcccagcagattttccggcagcggcttccac<br>accagcttcaacctgaccatcagcgatctgcaggccgacgacattgccacct<br>actattgtcaggtgctgcagttcttcggcagaggcagcagactgcacatcaa<br>gcgtacggtggccgctcccagcgtgttcatcttcccacctagcgacgagcag<br>ctgaagtccggcacagcctctgtcgtgtgcctgctgaacaacttctacccccg<br>cgaggccaaagtgcagtggaaggtggacaacgccctgcagagcggcaac<br>agccaggaaagcgtgaccgagcaggacagcaaggactccacctacagcct<br>gagcagcaccctgacactgagcaaggccgactacgagaagcacaaggtgt<br>acgcctgcgaagtgacccaccagggcctgtctagccccgtgaccaagagct<br>tcaaccggggcgagtgt | SEQ ID<br>NO: 62 |
| Heavy chain B | gaggttagactggtggagtcaggagggggggcttgtgaagcccggtgggtctctccg<br>cctgagctgttctgcctccggctttgatttcgataacgcctggatgacctgggtcaggc<br>agcctccaggtaagggactggagtgggtgggaagaatcacaggtccaggcgagg<br>gctggtccgtgactacgcggaatctgttaaagggcggtttacaatctcaagggaca<br>ataccaagaataccttgtatttggagatgaacaacgtgagaactgaagacaccggat<br>attacttctgtgccagaacaggcaaatactacgacttctggtggggctatcccctgg<br>cgaggaatattttcaagactggggtcagggaaccttgttatcgtgtcctccgacaaa<br>acccataccagggtgcagttggtggagtctgggggagggcgtggtccagcctggga<br>cgtccctgagactctcctgtgcagcctctcaattcaggttgatggttatggcatgcact<br>gggtccgccaggccccaggcaaggggctgagtgggtggcatctatatcacatga<br>tggaattaaaaagtatcacgcagaaaagtgtggggccgcttcaccatctccagaga<br>caattccaagaacacactgtatctacaaatgaacagcctgcgacctgaggacacgg<br>ctctctactactgtgcgaaagatttgcgagaagacgaatgtgaagagtggtggtcgg<br>attattacgattttgggaaacaactccttgcgcaaagtcacgcggcggcttggttgg<br>aattgctgataactggggccaagggacaatggtcaccgtctcttcagataagaccca<br>caccgcttccaccaaggccccatcggtcttccccctggcaccctcctccaagagca<br>cctctggggggacagcggccctgggctgcctggtcaaggactacttccccgaacc<br>ggtgacggtgtcgtggaactcaggcgccctgaccagcggcgtgcacaccttcccg<br>gctgtcctacagtcctcaggactctactccctcagcagcgtggtgaccgtgccctcca<br>gcagcttgggcacccagacctacatctgcaacgtgaatcacaagcccagcaacacc<br>aaggtggacaagaaagttgagcccaaatcttgtgacaaaactcacacatgcccacc<br>gtgcccagcacctgaactcctggggggaccgtcagtcttcctcttccccccaaaacc<br>caaggacaccctcatgatctcccggacccctgaggtcacatgcgtggtggtggacg<br>tgagccacgaagaccctgaggtcaagttcaactggtatgttgacggcgtggaggtg<br>cataatgccaagacaaagccgcggggaggagcagtacaacagcacgtaccgtgtg<br>gtcagcgtcctcaccgtcctgcaccaggactggctgaatggcaaggagtacaagtg<br>caaggtctccaacaaagccctcccagcccccatcgagaaaaccatctccaaagcca<br>aagggcagccccgagaaccacaggtgtacaccctgcccccatgccgggatgagct<br>gaccaagaatcaagtcagcctgtggtgcctggtaaaaggcttctatcccagcgacat<br>cgccgtggagtgggagagcaatgggcagccgagaacaactacaagaccacgc<br>ctcccgtgctggactccgacggctccttcttcctctactcaaaactcaccgtggacaa<br>gagcaggtggcagcaggggaacgtcttctcatgctccgtgatgcatgaggctctgc<br>acaaccactacacgcagaagagcctctccctgtctccgggt | SEQ ID<br>NO: 63 |

TABLE 2-continued

Heavy and light chain sequences of binding proteins. CDR sequences are bolded and italicized.

| | | |
|---|---|---|
| Light chain B | cagtctgtgctgacgcagccgccctcagtgtctgcggcccaggacagaa ggtcaccatctcctgctctggaaacacctccaacattggcaataattttgtgtcc tggtatcaacagcgccccggcagagccccccaactcctcatttatgaaactg acaagcgaccctcagggattcctgaccgattctctgcttccaagtctggtacgt caggcaccctggccatcaccgggctgcagactggggacgaggccgattatt actgcgcacatgggctgccagcctgagttccgcgcgtgtcttcggaactgg gaccaaggtcatcgtcctggacaaaacccataccgcatccgaactgactcag gaccctgccgtctctgtggcactgaagcagactgtgactattacttgccagg cgactcactgcggagccactacgcttcctggtatcagaagaaacccggcca ggcacctgtgctgctgttctacggaaagaacaataggccatctggcatcccc gaccgcttttctggcagtgcatcagggaaccgagccagtctgaccattaccg gcgcccaggctgaggacgaagccgattactattgcagctcccgggataaga gcggctccagactgagcgtgttcggaggaggaactaaactgaccgtcctcg ataagacccataccccgtacggtggccgctcccagcgtgttcatcttcccacct agcgacgagcagctgaagtccggcacagcctctgtcgtgtgcctgctgaac aacttctaccccgcgaggccaaagtgcagtggaaggtggacaacgccctg cagagcggcaacagccaggaaagcgtgaccgagcaggacagcaaggac tccacctacagcctgagcagcaccctgacactgagcaaggccgactacgag aagcacaaggtgtacgcctgcgaagtgacccaccagggcctgtctagcccc gtgaccaagagcttcaaccgggggcgagtgt | SEQ ID NO: 64 |

Binding Protein 9 Amino Acid Sequences

| | | |
|---|---|---|
| Heavy chain A | Qvqlvqsggqmkkpgesmriscrasgyefidctlnwirlapgkrpewmgwlk prggavnyarplqgrvtmtrdvysdtaflelrsltvddtavyfctrgkncdynwdf ehwgrgtpvivssastkgpsvfplapsskstsggtaalgclvkdyfpepvtvswns galtsgvhtfpavlqssglyslssvvtvpssslgtqtyicnvnhkpsntkvdkkvep kscdkthtcppcpapellggpsvflfppkpkdtlmisrtpevtcvvvdvshedpe vkfnwyvdgvevhnaktkpreeqynstyrvvsvltvlhqdwlngkeykckvsn kalpapiektiskakgqprepqvctlppsrdeltknqvslscavkgfypsdiavew esngqpennykttppvldsdgsfflvskltvdksrwqqgnvfscsvmhealhnh ytqkslslspg | SEQ ID NO: 65 |
| Light chain A | Eivltqspgtlslspgetaiiscrtsqygslawyqqrpgqaprlviysgstraagipdr fsgsrwgpdynltisnlesgdfgvyycqqyeffgqgtkvqvdikrtvaapsvfifp psdeqlksgtasvvcllnnfypreakvqwkvdnalqsgnsqesvteqdskdstys lssltltlskadyekhkvyacevthqglsspvtksfnrgec | SEQ ID NO: 66 |
| Heavy chain B | Evrlvesgggglvkpggslrlscsasgfdfdnawmtwvrqppgkglewv grigtpgegwsvdyaesvkgrftisrdntkntlylemnnvrtedtgyyfcar tgkyydfwwgyppgeeyfqdwgqgtlvivssdkthtqvqlvesgggvv qpgtslrlscaasqfrfdgygmhwvrqapgkglewvasishdgikkyha ekvwgrftisrdnsknt1ylqmnslrpedtalyycakd1rededceeewwsd yydfgkqlpcaksrgglvgiadnwgqgtmvtvssdkthtastkgpsvfpl apssksgtsggtaalgclvkdyfpepvtvswnsgaltsgvhtfpavlqssgly slssvvtvpssslgtqtyicnvnhkpsntkvdkkvepkscdkthtcppcpa pellggpsvflfppkpkdtlmisrtpevtcvvvdvshedpevkfnwyvd gvevhnaktkpreeqynstyrvvsvltvlhqdwlngkeykckvsnkalp apiektiskakgqprepqvytlppcrdeltknqvslwclvkgfypsdiave wesngqpennykttppvldsdgsfflysklkvdksrwqqgnvfscsvmh ealhnhytqkslslspg | SEQ ID NO: 67 |
| Light chain B | qsvltqppsysaapgqkvtiscsgntsnignnfvswyqqrpgrapqlliyetdkrp sgipdrfsasksgtsgtlaitglqtgdeadyycatwaaslssarvfgtgtkvivldkth taseltqdpavsvalkqtvtitcrgdslrshyaswyqkkpgqapvllfygknnrps gipdrfsgsasgnrasltitgaqaedeadyycssrdksgsrlsvfggtkltvldkth rtvaapsvfifppsdeqlksgtasvvcllnnfypreakvqwkvdnalqsgnsqes vteqdskdstyslssltltlskadyekhkvyacevthqglsspvtksfnrgec | SEQ ID NO: 68 |

Binding Protein 9 Nucleotide Sequences

| | | |
|---|---|---|
| Heavy chain A | caggtgcagctggtgcagtctggcggccagatgaagaaacccggcgagagcatgc ggatcagctgcagagccagcggctacgagttcatcgactgcaccctgaactggatc agactggcccctggcaagcggcctgagtggatgggatggctgaagcctagaggcg gagccgtgaactacgccagacctctgcagggcagagtgaccatgacccgggacgt gtacagcgataccgccttcctggaactgcggagcctgaccgtggatgataccgccgt gtacttctgcacccggggcaagaactgcgactacaactgggacttcgagcactggg gcagaggcacccctgtgatcgtgtcaagcgcgtcgaccaaggcccccagcgtgttc cctctgcccctagcagcaagagcacatctggcggaacagccgccctgggctgcct cgtgaaggactactttcccgagcccgtgaccgtgtcctgaattctggcgccctgac cagcggcgtgcacacctttccagctgtgctgcagtccagcggcctgtacagcctgag cagcgtcgtgacagtgcccagcagctctctgggcacccagacctacatctgcaacgt gaaccacaagcccagcaacaccaaggtggacaagaaggtggaacccaagagctg cgacaagacccacacctgtcccccttgtcctgcccccgaactgctgggaggcccttc cgtgttcctgttccccccaaagcccaaggacaccctgatgatcagccggaccccg aagtgacctgcgtggtggtggatgtgtcccacgaggaccctgaagtgaagttcaatt ggtacgtggacggcgtggaagtgcacaacgccaagaccaagccaagagaggaac | SEQ ID NO: 69 |

TABLE 2-continued

Heavy and light chain sequences of binding proteins. CDR sequences are bolded and italicized.

| | | |
|---|---|---|
| | agtacaacagcacctaccgggtggtgtccgtgctgaccgtgctgcaccaggactgg<br>ctgaacggcaaagagtacaagtgcaaggtgtccaacaaggccctgcctgcccccat<br>cgagaaaaccatcagcaaggccaagggccagccccgcgaaccccaggtgtgcac<br>actgccccaagcagggacgagctgaccaagaaccaggtgtccctgagctgtgcc<br>gtgaaaggcttctaccccctccgatatcgccgtggaatgggagagcaacgccagcc<br>cgagaacaactacaagaccaccccccctgtgctggacagcgacggctcattcttcct<br>ggtgtccaagctgacagtggacaagtcccggtggcagcagggcaacgtgttcagct<br>gctccgtgatgcacgaggccctgcacaaccactacacccagaagtccctgagcctg<br>agccccggc | |
| Light<br>chain<br>A | gagatcgtgctgacacagagccctggcaccctgagcctgtctccaggcgagacag<br>ccatcatcagctgccggacaagccagtacggcagcctggcctggtatcagcagag<br>gcctggacaggcccccagactcgtgatctacagcggcagcacaagagccgccgg<br>aatccccgatagattcagcggctccagatggggccctgactacaacctgaccatcag<br>caacctggaaagcggcgacttcggcgtgtactactgccagcagtacgagttcttcgg<br>ccagggcaccaaggtgcaggtggacatcaagcgtacggtggccgctcccagcgtg<br>ttcatcttcccacctagcgacgagcagctgaagtccggcacagcctctgtcgtgtgcc<br>tgctgaacaacttctaccccgcgaggccaaagtgcagtggaaggtggacaacgcc<br>ctgcagagcggcaacagccaggaaagcgtgaccgagcaggacagcaaggactc<br>cacctacagcctgagcagcaccctgacactgagcaaggccgactacgagaagcac<br>aaggtgtacgcctgcgaagtgacccaccagggcctgtctagccccgtgaccaaga<br>gcttcaaccggggcgagtgt | SEQ ID<br>NO: 70 |
| Heavy<br>chain<br>B | gaggttagactggtggagtcaggaggggggcttgtgaagcccggtggtctctccg<br>cctgagctgttctgcctccggctttgatttcgataacgcctggatgacctgggtcaggc<br>agcctccaggtaagggactggagtgggtgggaagaatcacagagtccaggcgagg<br>gctggtccgtggactacgcggaatctgttaaagggcggtttacaatctcaagggaca<br>ataccaagaataccttgtatttggagatgaacaacgtgagaactgaagacaccggat<br>attacttctgtgccagaacaggcaaatactacgacttctggtggggctatccccctgg<br>cgaggaatattttcaagactggggtcagggaaccccttgttatcgtgtcctccgacaaa<br>acccataccaggtgcagttggtggagtctgggggaggcgtggtccagcctggga<br>cgtccctgagactctcctgtgcagcctctcaattcaggtttgatggttatggcatgcact<br>gggtccgccaggcccaggcaaggggctggagtgggtggcatctatatcacatgat<br>ggaattaaaaagtatcacgcagaaaaagtgtggggccgcttcaccatctccagagac<br>aattccaagaacacactgtatctacaaatgaacagcctgcgacctgaggacacggct<br>ctctactactgtgcgaaagatttgcgagaagacgaatgtgaagagtggtggtcggatt<br>attacgattttgggaaacaactcccttgcgcaaagtcacgcggcggcttggttggaatt<br>gctgataactggggccaagggacaatggtcaccgtctcttcagataagacccacacc<br>gcttccaccaagggcccatcggtcttccccctggcacctctcctccaagagcacctct<br>gggggcacagcggccctgggctgcctggtcaaggactactttcccgaaccggtga<br>cggtgtcgtggaactcaggcgccctgaccagcggcgtgcacaccttccggctgtc<br>ctacagtcctcaggactctactccctcagcagcgtggtgaccgtgccctccagcagc<br>ttgggcacccagacctacatctgcaacgtgaatcacaagcccagcaacaccaaggt<br>ggacaagaaagttgagcccaaatcttgtgacaaaactcacacatgcccaccgtgccc<br>agcacctgaactcctgggggaccgtcagtcttcctcttccccccaaaacccaagga<br>caccctcatgatctcccggacccctgaggtcacatgcgtggtggtggacgtgagcca<br>cgaagaccctgaggtcaagttcaactggtatgttgacggcgtggaggtgcataatgc<br>caagacaaagccgcgggaggagcagtacaacagcacgtaccgtgtggtcagcgtc<br>ctcaccgtcctgcaccaggactggctgaatggcaaggagtacaagtgcaaggtctc<br>caacaaagccctcccagcccccatcgagaaaaccatctccaaagccaaagggcag<br>ccccgagaaccacaggtgtacaccctgcccccatgcgggatgagctgaccaaga<br>atcaagtcagcctgtggtgcctggtaaaaggcttctatcccagcgacatcgccgtgg<br>agtgggagagcaatgggcagccggagaacaactacaagaccacgcctcccgtgct<br>ggactccgacggctccttcttcctctactcaaaactcaccgtggacaagagcaggtg<br>gcagcaggggaacgtcttctcatgctccgtgatgcatgaggctctgcacaaccacta<br>cacgcagaagagcctctccctgtctccgggt | SEQ ID<br>NO: 71 |
| Light<br>chain<br>B | cagtctgtgctgacgcagccgccctcagtgtctgcggcccaggacagaaggtcac<br>catctcctgctctggaaacacctcaacattggcaataattttgtgtcctggtatcaaca<br>gcgccccggcagagcccccaaactcctcatttatgaaactgacaagcgaccctcag<br>ggattcctgaccgattctctgcttccaagtctggtacgtcaggcaccctggccatcacc<br>gggctgcagactggggacgaggccgattattactgcgccacatgggctgccagcct<br>gagttccgcgcgtgtcttcggaactgggaccaaggtcatcgtcctg<br>gacaaaaccatacctatccgaactgactcaggaccctgccgtctctgtggcactg<br>aagcagactgtgactattacttgccgaggcgactcactgcggagccactacgcttcct<br>ggtatcagaagaaacccggccaggcacctgtgctgctgttctacggaaagaacaat<br>aggccatctggcatccccgaccgcttttctggcagtgcatcagggaaccgagccagt<br>ctgaccattaccggcgcccaggctgaggacgaagccgattactattgcagctcccg<br>ggataagagcggctccagactgagcgtgttcggaggaggaactaaactgaccgtcc<br>tcgataagacccataccc gtacggtggccgctcccagcgtgttcatcttcccacctag<br>cgacgagcagctgaagtccggcacagcctctgtcgtgtgcctgctgaacaacttcta<br>ccccgcgaggccaaagtgcagtggaaggtggacaacgccctgcagagcggcaa<br>cagccaggaaagcgtgaccgagcaggacagcaaggactccacctacagcctgag<br>cagcaccctgacactgagcaaggccgactacgagaagcacaaggtgtacgcctgc<br>gaagtgacccaccagggcctgtctagccccgtgaccaagagcttcaaccggggcg<br>agtgt | SEQ ID<br>NO: 72 |

TABLE 2-continued

Heavy and light chain sequences of binding proteins. CDR sequences are bolded and italicized.

Binding Protein 10 Amino Acid Sequences

| | | |
|---|---|---|
| Heavy chain A | Qvqlvqsggqmkkpgesmriscrasgyefidctlnwirlapgkrpewmgwlk prggavnyarplqgrvtmtrdvysdtaflelrsltvddtavyfctrgkncdynwdf ehwgrgtpvivssastkgpsvfplapsskstsggtaalgclykdyfpepvtvswns galtsgvhtfpavlqssglyslssvvtvpssslgtqtyicnvnhkpsntkvdkkvep kscdkthtcppcpapellggpsvflfppkpkdtlmisrtpevtcvvvdvshedpe vkfnwyvdgvevhnaktkpreeqynstyrvvsvltvlhqdwlngkeykckvsn kalpapiektiskakgqprepqvctlppsrdeltknqvslscavkgfypsdiavew esngqpennykttppvldsdgsfflvskltvdksrwqqgnvfscsvmhealhnh ytqkslslspg | SEQ ID NO: 73 |
| Light chain A | Eivltqspgtlslspgetaiiscrtsqygslawyqqrpgqaprlviysgstraagipdr fsgsrwgpdynltisnlesgdfgvyycqqyeffgqgtkvqvdikrtvaapsvfifp psdeqlksgtasvvcllnnfypreakvqwkvdnalqsgnsqesvteqdskdstys lsstltlskadyekhkvyacevthqglsspvtksfnrgec | SEQ ID NO: 74 |
| Heavy chain B | Qvqlvesgggvvqpgtslrlscaasqfrfdgygmhwvrqapgkglewv asishdgikkyhaekvwgrftisrdnskntlylqmnslrpedtalyycakd lredeceewwsdyydfgkqlpcaksrgglvgiadnwgqgtmvtvssdk thtevrlvesggglvkpggslrlscsasgfdfdnawmtwvrqppgkgle wvgritgpgegwsvdyaesvkgrftisrdntkntlylemnnvrtedtgyyf cartgkyydfwwgyppgeeyfqdwgqgtlvivssdkthtastkgpsvfp lapsskstsggtaalgclvkdyfpepvtvswnsgaltsgvhtfpavlqssgl yslssvvtvpssslgtqtyicnvnhkpsntkvdkkvepkscdkthtcppcp apellggpsvflfppkpkdtlmisrtpevtcvvvdvshedpevkfnwyvd gvevhnaktkpreeqynstyrvvsvltvlhqdwlngkeykckvsnkalp apiektiskakgqprepqvytlppcrdeltknqvslwclvkgfypsdiave wesngqpennykttppvldsdgsfflyskltvdksrwqqgnvfscsvmh ealhnhytqkslslspg | SEQ ID NO: 75 |
| Light chain B | taseltqdpavsvalkqtvtitcrgdslrshyaswyqkkpgqapvllfygknnrpsg ipdrfsgsasgnrasltitgaqaedeadyycssrdksgsrlsvfgggtkltvldkthtq svltqppsvsaapgqkvtiscsgntsnignnfvswyqqrpgrapqlliyetdkrps gipdrfsasksgtsgtlaitglqtgdeadyycatwaaslssarvfgtgtkvivldktht rtvaapsvfifppsdeqlksgtasvvcllnnfypreakvqwkvdnalqsgnsqes vteqdskdstyslsstltlskadyekhkvyacevthqglsspvtksfnrgec | SEQ ID NO: 76 |

Binding Protein 10 Nucleotide Sequences

| | | |
|---|---|---|
| Heavy chain A | caggtgcagctggtgcagtctggcggccagatgaagaaacccggcgagagcatg cggatcagctgcagagccagcggctacgagttcatcgactgcaccctgaactggat cagactggcccctggcaagcggcctgagtggatgggatggctgaagcctagaggc ggagccgtgaactacgccagacctctgcagggcagagtgaccatgacccgggac gtgtacagcgataccgccttcctggaactgcggagcctgaccgtggatgataccgc cgtgtacttctgcacccggggcaagaactgcgactacaactgggacttcgagcact ggggcagaggcacccctgtgatcgtgtcaagcgcgtcgaccaagggccccagcg tgttccctctggcccctagcagcaagagcacatctggcggaacagccgccctgggc tgcctcgtgaaggactactttcccgagcccgtgaccgtgtcctggaattctggcgccc tgaccagcggcgtgcacaccttttccagctgtgctgcagtccagcggcctgtacagc ctgagcagcgtcgtgacagtgcccagcagctctctgggcacccagacctacatctg caacgtgaaccacaagcccagcaacaccaaggtggacaagaaggtggaacccaa gagctgcgacaagacccacacctgtcccccttgtcctgccccgaactgctgggag gcccttccgtgttcctgttcccccaaagcccaaggacacctgatgatcagccgga cccccgaagtgacctgcgtggtggtggatgtgtcccacgaggaccctgaagtgaag ttcaattggtacgtggacggcgtggaagtgcacaacgccaagaccaagccaagag aggaacagtacaacagcacctaccgggtggtgtccgtgctgaccgtgctgcaccag gactggctgaacggcaaagagtacaagtgcaaggtgtccaacaaggccctgcctg cccccatcgagaaaaccatcagcaaggccaagggccagccccgcgaacccag gtgtgcacactgccccaagcagggacgagctgaccaagaaccaggtgtccctga gctgtgccgtgaaaggcttctaccccctccgatatcgccgtggaatgggagagcaac ggccagcccgagaacaactacaagaccacccccctgtgctggacagcgacggc tcattcttcctggtgtccaagctgacagtggacaagtcccggtggcagcagggcaac gtgttcagctgctccgtgatgcacgaggccctgcacaaccactacacccagaagtc cctgagcctgagccccggc | SEQ ID NO: 77 |
| Light chain A | gagatcgtgctgacacagagccctggcaccctgagcctgtctccaggcgagacag ccatcatcagctgccggacaagccagtacggcagcctggcctggtatcagcagag gcctggacaggcccccagactcgtgatctacagcggcagcacaagagccgccgg aatccccgatagattcagcggctccagatgggccctgactacaacctgaccatca gcaacctggaaagcggcgacttcggcgtgtactactgccagcagtacgagttcttcg gccagggcaccaaggtgcaggtggacatcaagcgtacggtggccgctcccagcg tgttcatcttcccacctagcgacgagcagctgaagtccggcacagcctctgtcgtgtg cctgctgaacaacttctaccccgcgaggccaaagtgcagtggaaggtggacaac gccctgcagagcggcaacagccaggaaagcgtgaccgagcaggacagcaagga | SEQ ID NO: 78 |

TABLE 2-continued

Heavy and light chain sequences of binding proteins. CDR sequences are bolded and italicized.

| | | |
|---|---|---|
| | ctccacctacagcctgagcagcaccctgacactgagcaaggccgactacgagaag<br>cacaaggtgtacgcctgcgaagtgacccaccagggcctgtctagccccgtgacca<br>agagcttcaaccggggcgagtgt | |
| Heavy<br>chain<br>B | caggtgcagttggtggagtctgggggaggcgtggtccagcctgggacgtccctga<br>gactctcctgtgcagcctctcaattcaggtttgatggttatggcatgcactgggtccgc<br>caggccccaggcaaggggctggagtgggtggcatctatatcacatgatggaattaa<br>aaagtatcacgcagaaaaagtgtggggccgcttcaccatctccagagacaattccaa<br>gaacacactgtatctacaaatgaacagcctgcgacctgaggacacggctctctacta<br>ctgtgcgaaagatttgcgagaagacgaatgtgaagagtggtggtcggattattacga<br>ttttgggaaacaactcccttgcgcaaagtcacgcggcggcttggttggaattgctgat<br>aactggggccaagggacaatggtcaccgtctcttcagacaaaacccataccgaggt<br>tagactggtggagtcaggagggggggcttgtgaagcccggtgggtctctccgcctga<br>gctgttctgcctccggctttgatttcgataacgcctggatgacctgggtcaggcagcct<br>ccaggtaagggactggagtgggtgggaagaatcacaggtccaggcgagggctgg<br>tccgtggactacgcggaatctgttaaagggcggtttacaatctcaagggacaatacc<br>aagaatacctttgtatttggagatgaacaacgtgagaactgaagacaccgatattact<br>tctgtgccagaacaggcaaatactacgacttctggtccggctatcccccctggcgagg<br>aatattttcaagactgggtcagggaaccccttgttatcgtgtcctccgataagacccac<br>accgcttccaccaagggcccatcggtcttccccctggcaccctcctccaagagcac<br>ctctgggggcacagcggccctgggctgcctggtcaaggactacttccccgaaccg<br>gtgacggtgtcgtggaactcaggcgccctgaccagcggcgtgcacaccttcccgg<br>ctgtcctacagtcctcaggactctactccctcagcagcgtggtgaccgtgccctccag<br>cagcttgggcacccagacctacatctgcaacgtgaatcacaagcccagcaacacca<br>aggtggacaagaaagttgagcccaaatcttgtgacaaaactcacacatgcccaccgt<br>gcccagcacctgaactcctggggggaccgtcagtcttcctcttccccccaaaaccca<br>aggacaccctcatgatctcccggacccctgaggtcacatgcgtggtggtggacgtg<br>agccacgaagaccctgaggtcaagttcaactggtatgttgacggcgtggaggtgca<br>taatgccaagacaaagccgcgggaggagcagtacaacagcacgtaccgtgtggtc<br>agcgtcctcaccgtcctgcaccaggactggctgaatggcaaggagtacaagtgcaa<br>ggtctccaacaaagccctcccagcccccatcgagaaaaccatctctccaaagccaaag<br>ggcagccccgagaaccacaggtgtacaccctgcccccatgccgggatgagctgac<br>caagaatcagtcagcctgtggtgcctggtaaaaggcttctatcccagcgacatcgc<br>cgtggagtgggagagcaatgggcagccggagaacaactacaagaccacgcctcc<br>cgtgctggactccgacggctccttcttcctctactcaaaactcaccgtggacaagagc<br>aggtggcagcaggggaacgtcttctcatgctccgtgatgcatgaggctctgcacaac<br>cactacacgcagaagagcctctccctgtctccgggt | SEQ ID<br>NO: 79 |
| Light<br>chain<br>B | gcatccgaactgactcaggaccctgccgtctctgtggcactgaagcagactg<br>tgactattacttgccgaggcgactcactgcggagccactacgcttcctggtat<br>cagaagaaacccggccaggcacctgtgctgctgttctacggaaagaacaat<br>aggccatctggcatccccgaccgcttttctggcagtgcatcagggaaccgag<br>ccagtctgaccattaccggcgcccaggctgaggacgaagccgattactattg<br>cagctcccgggataagagcggctccagactgagcgtgttcggaggaggaa<br>ctaaactgaccgtcctcgacaaaacccatacc<br>cagtctgtgctgacgcagccgcctcagtgtctgcggccccaggacagaag<br>gtcaccatctcctgctctggaaacacctccaacattggcaataattttgtgtcct<br>ggtatcaacagcgccccggcagagcccccaactcctcatttatgaaactga<br>caagcgaccctcagggattcctgaccgattctctgcttccaagtctggtacgtc<br>aggcaccctggccatcaccgggctgcagactggggacgaggccgattatta<br>ctgcgccacatgggctgccagcctgagttccgcgcgtgtcttcggaactggg<br>accaaggtcatcgtcctg<br>gataagacccataccgtacggtggccgctcccagcgtgttcatcttcccacc<br>tagcgacgagcagctgaagtccggcacagcctctgtcgtgtgcctgctgaac<br>aacttctaccccgcgaggccaaagtgcagtggaaggtggacaacgccctg<br>cagagcggcaacagccaggaaagcgtgaccgagcaggacagcaaggac<br>tccacctacagcctgagcagcaccctgacactgagcaaggccgactacgag<br>aagcacaaggtgtacgcctgcgaagtgacccaccagggcctgtctagcccc<br>gtgaccaagagcttcaaccggggcgagtgt | SEQ ID<br>NO: 80 |

Binding Protein 11 Amino Acid Sequences

| | | |
|---|---|---|
| Heavy<br>chain<br>A | Rahlvqsgtamkkpgasvrvscqtsgytftahilfwfrqapgrglewvgwikpq<br>nygavnfggqfrdrvtltrdvyreiaymdirglkpddtavyycardrsygdsswal<br>dawgqgttvvvsaastkgpsvfplapsskstsggtaalgclvkdyfpepvtvswn<br>sgaltsgvhtfpavlqssglyslssvvtvpssslgtqtyicnvnhkpsntkvdkkve<br>pkscdkthtcppcpapellggpsvflfppkpkdtlmisrtpevtcvvvdvshedp<br>evkfnwyvdgvevhnaktkpreeqynstyrvvsvltvlhqdwlngkeykckvs<br>nkalpapiektiskakgqprepqvctlppsrdeltknqvslscavkgfypsdiave<br>wesngqpennykttppvldsdgsfflvskltvdksrwqqgnvfscsvmhealhn<br>hytqkslslspg | SEQ ID<br>NO: 81 |
| Light<br>chain<br>A | yihvtqspsslsvsigdrvtincqtsqgvgsdlhwyqhkpgrapkllihhtssved<br>ngvpsrfsgsgfhtsfnltisdlqaddiatyycqvlqffgrgsrlhikrtvaapsvfifpp<br>sdeqlksgtasvvcllnnfypreakvqwkvdnalqsgnsqesvteqdskdstysl<br>sstltlskadyekhkvyacevthqglsspvtksfnrgec | SEQ ID<br>NO: 82 |

TABLE 2-continued

Heavy and light chain sequences of binding proteins. CDR sequences are bolded and italicized.

| | | |
|---|---|---|
| Heavy chain B | yevrlvesggglvkpggslrlscsasgfdfdnawmtwvrqppgkglewvg ritgpgegwsvdyaesvkgrftisrdntkntlylemnnvrtedtgyyfcart gkyydfwwgyppgeeyfqdwgqgtlvivssdkthtqvhltqsgpevrk pgtsvkvsckapgntlktydlhwvrsvpgqglqwmgwishegdkkviv erfkakvtidwdrstntaylqlsgltsgdtavyycakgskhrlrdyalyddd galnwavdvdylsnlefwgqgtavtvssdkthtastkgpsvfplapssksts sggtaalgclvkdyfpepvtvswnsngaltsgvhtfpavlqssglyslssvvt vpssslgtqtyicnvnhkpsntkvdkkvepkscdkthtcppcpapellgg psvflfppkpkdtlmisrtpevtcvvvdvshedpevkfnwyvdgvevhn aktkpreeqynstyrvvsvltvlhqdwlngkeykckvsnkalpapiektis kakgqprepqvytlppcrdeltknqvslwclvkgfypsdiavewesngq penvykttppvldsdgsfflysklvtdksrwqqgnvfscsvmhealhnhy tqkslslspg | SEQ ID NO: 83 |
| Light chain B | tdfvltqsphslsvtpgesasiscksshslihgdrnnylawyvqkpgrspqlliylass rasgvpdrfsgsgsdkdftlkisrvetedvgtyycmqgrespwtfgqgtkvdikd kthtaseltqdpavsvalkqtvtitcrgdslrshyaswyqkkpgqapvllfygknnr psgipdrfsgsasgnraslitgaqaedeadyycssrdksgsrlsvfggtkltvldk thtrtvaapsvfifppsdeqlksgtasvvcllnnfypreakvqwkvdnalqsgnsq esvteqdskdstyslsstltlskadyekhkvyacevthqglsspvtksfnrgec | SEQ ID NO: 84 |

Binding Protein 11 Nucleotide Sequences

| | | |
|---|---|---|
| Heavy chain A | agagcccacctggtgcagtctggcaccgccatgaagaaaccaggcgcctctgtgc ggtgtcctgtcagacaagcggctacaccttcaccgcccacatcctgttctggttccg gcaggcccctggcagaggactggaatgggtgggatggatcaagcccccagtatggc gccgtgaacttcggcggaggcttccgggatagagtgacccctgacccgggacgtgta ccgcgagatcgcctacatggacatccggggcctgaagcccgatgacaccgccgtg tactactgcgccagagacagaagctacggcgacagcagctgggtctggatgcttg gggccagggcacaaccgtggtggtgtctgccgcctctacaaagggcccagcgtg ttccctctggccctagcagcaagagcacatctggcggaacgccgccctgggctg cctcgtgaaggactactttcccgagcccgtgaccgtgtcctggaattctggcgccctg accagcggcgtgcacacctttccagctgtgctgcagtccagcggcctgtacagcctg agcagcgtcgtgacagtgcccagcagctctctgggcacccagacctacatctgcaa cgtgaaccacaagcccagcaacaccaaggtggacaagaaggtgaacccaagag ctgcgacaagacccacacctgtccccttgtcctgccccgaactgctgggaggcc cttccgtgttcctgttcccccaaagcccaaggacaccctgatgatcagccggaccc ccgaagtgacctgcgtggtggtggatgtgtcccacgaggaccctgaagtgaagttca attggtacgtggacggcgtggaagtgcacaacgccaagaccaagccaagagagg aacagtacaacagcacctaccgggtggtgtccgtgctgaccgtgctgcaccaggac tggctgaacggcaaagagtacaagtgcaaggtgtccaacaaggccctgcctgccc catcgagaaaaccatcagcaaggccaagggccagccccgcgaacccaggtgtg cacactgccccaagcagggacgagctgaccaagaaccaggtgtcctgagctgt gccgtgaaaggcttctaccctccgatatcgccgtgaatgggagagcaacggcca gcccgagaacaactacaagaccacccccctgtgctggacagcgacggctcattct tcctggtgtccaagctgacagtggacaagtcccgtggcagcagggcaacgtgttc agctgctccgtgatgcacgaggccctgcacaaccactacacccagaagtccctgag cctgagccccggcaag | SEQ ID NO: 85 |
| Light chain A | ttacatccacgtgacccagagccccagcagcctgtccgtgtccatcggcgac agagtgaccatcaactgccagacctctcagggcgtgggcagcgacctgcac tggtatcagcacaagcctggcagagccccaagctgctgatccaccacaca agcagcgtggaagatggcgtgcccagcagattttccggcagcggcttccac accagcttcaacctgaccatcagcgatctgcaggccgacgacattgccacct actattgtcaggtgctgcagttcttcggcagaggcagcagactgcacatcaag cgtacggtggccgctcccagcgtgttcatcttcccacctagcgacgagcagc tgaagtccggcacagcctctgtcgtgtgcctgctgaacaacttctaccccgc gaggccaaagtgcagtggaaggtggacaacgccctgcagagcggcaaca gccaggaaagcgtgaccgagcaggacagcaaggactccacctacagcctg agcagcaccctgacactgagcaaggccgactacgagaagcacaaggtgta cgcctgcgaagtgacccaccagggcctgtctagccccgtgaccaagagctt caaccggggcgagtgt | SEQ ID NO: 86 |
| Heavy chain B | gaggttagactggtggagtcaggaggggggcttgtgaagcccggtgggtctctccg cctgagctgttctgcctccggcttttgatttcgataacgcctggatgacctgggtcaggc agcctccaggtaagggactggagtgggtgggaagaatcacaggtccaggcgagg gctggtccgtggactacgcggaatctgttaaagggcggtttacaatctcaagggaca ataccaagaataccttgtatttggagatgaacaacgtgagaactgaagacaccggat attacttctgtgccagaacaggcaaatactacgacttctggtggggctatcccctgg cgaggaatattttcaagactggggtcagggaacccttgttatcgtgtcctccgacaaa acccataccaggtgcacctgacacagagcggacccgaagtgcggaagcctggc acctctgtgaaggtgtcctgcaaggccctggcaacacctgaaaacctacgacctg cactgggtgcgcagcgtgccaggacagggactgcagtggatgggctggatcagc acgagggcgacaagaaagtgatcgtggaacggttcaaggccaaagtgaccatcga ctgggacagaagcaccaacaccgcctacctgcagctgagcggcctgacctctggc gataccgccgtgtactactgcgccaagggcagcaagcaccggctgagagactacg cctgtacgacgatgacggcgcctgaactgggccgtggatgtggactacctgagc | SEQ ID NO: 87 |

TABLE 2-continued

Heavy and light chain sequences of binding proteins. CDR sequences are bolded and italicized.

| | | |
|---|---|---|
| | aacctggaattctggggccagggcacagccgtgaccgtgtcatctgataagaccca<br>caccgcttccaccaagggcccatcggtcttccccctggcaccctcctccaagagcac<br>ctctgggggcacagcggccctgggctgcctggtcaaggactacttccccgaaccgg<br>tgacggtgtcgtggaactcaggcgccctgaccagcggcgtgcacaccttcccggct<br>gtcctacagtcctcaggactctactccctcagcagcgtggtgaccgtgccctccagc<br>agcttgggcacccaacctacatctgcaacgtgaatcacaagcccagcaacaccaa<br>ggtggacaagaaagttgagcccaaatcttgtgacaaaactcacacatgcccaccgtg<br>cccagcacctgaactcctgggggggaccgtcagtcttcctcttccccccaaaacccaa<br>ggacaccctcatgatctcccggacccctgaggtcacatgcgtggtggtggacgtga<br>gccacgaagaccctgaggtcaagttcaactggtatgttgacggcgtggaggtgcata<br>atgccaagacaaagccgcgggaggagcagtacaacagcacgtaccgtgtggtcag<br>cgtcctcaccgtcctgcaccaggactggctgaatggcaaggagtacaagtgcaagg<br>tctccaacaaagccctcccagcccccatcgagaaaaccatctccaaagccaaaggg<br>cagccccgagaaccacaggtgtacaccctgcccccatgccgggatgagctgacca<br>agaatcaagtcagcctgtggtgcctggtaaaaggcttctatcccagcgacatcgccgt<br>ggagtgggagagcaatgggcagccggagaacaactacaagaccacgcctcccgt<br>gctggactccgacggctccttcttcctctactcaaaactcaccgtggacaagagcag<br>gtggcagcaggggaacgtcttctcatgctccgtgatgcatgaggctctgcacaacca<br>ctacacgcagaagagcctctccctgtctccgggt | |
| Light<br>chain<br>B | gacttcgtgctgacccagagccctcacagcctgagcgtgacacctggcgag<br>agcgccagcatcagctgcaagagcagccactccctgatccacggcgaccg<br>gaacaactacctggcttggtacgtgcagaagcccggcagatcccccagct<br>gctgatctacctggccagcagcagagccagcggcgtgcccgatagatttct<br>ggcagcggcagcgacaaggacttcaccctgaagatcagccgggtggaaac<br>cgaggacgtgggcacctactactgtatgcagggcagagagagccccctgga<br>cctttggccagggcaccaaggtggacatcaaggacaaaacccatacccgcat<br>ccgaactgactcaggaccctgccgtctctgtggcactgaagcagactgtgac<br>tattacttgccgaggcgactcactgcggagccactacgcttcctggtatcaga<br>agaaacccgccaggcacctgtgctgctgttctacggaaagaacaataggc<br>catctggcatccccgaccgcttttctggcagtgcatcagggaaccgagccag<br>tctgaccattaccggcgcccaggctgaggacgaagccgattactattgcagc<br>tcccgggataagagcggctccagactgagcgtgttcggaggaggaactaaa<br>ctgaccgtcctcgataagacccataccgtacggtggccgctcccagcgtgt<br>tcatcttcccacctagcgacgagcagctgaagtccggcacagcctctgtcgt<br>gtgcctgctgaacaacttctaccccgcgaggccaaagtgcagtggaaggt<br>ggacaacgccctgcagagcggcaacagccaggaaagcgtgaccgagcag<br>gacagcaaggactccacctacagcctgagcagcaccctgacactgagcaa<br>ggccgactacgagaagcacaaggtgtacgcctgcgaagtgacccaccagg<br>gcctgtctagccccgtgaccaagagcttcaaccggggcgagtgt | SEQ ID<br>NO: 88 |

Binding Protein 12 Amino Acid Sequences

| | | |
|---|---|---|
| Heavy<br>chain<br>A | Rahlvqsgtamkkpgasvrvscqtsgytftahilfwfrqapgrglewvgwikpq<br>nygavnfgggfrdrvtltrdvyreiaymdirglkpddtavyycardrsygdsswal<br>dawgqggttvvvsaastkgpsvfplapssksstsggtaalgclvkdyfpepvtvswn<br>sgaltsgvhtfpavlqssglyslssvvtvpssslgtqtyicnvnhkpsntkvdkkve<br>pkscdkthtcppcpapellggpsvflfppkpkdtlmisrtpevtcvvvdvshedp<br>evkfnwyvdgvevhnaktkpreeqynstyrvvsvltvlhqdwlngkeykckvs<br>nkalpapiektiskakgqprepqvctlppsrdeltknqvslscavkgfypsdiave<br>wesngqpennykttppvldsdgsfflvskltvdksrwqqgnvfscsvmhealhn<br>hytqkslslspg | SEQ ID<br>NO: 89 |
| Light<br>chain<br>A | yihvtqspsslsvsigdrvtincqtsqgvgsdlhwyqhkpgrapkllihhtssved<br>gvpsrfsgsgfhtsfnltisdlqaddiatyycqvlqffgrgsrlhikrtvaapsvfifpp<br>sdeqlksgtasvvcllnnfypreakvqwkvdnalqsgnsqesvteqdskdstysl<br>sstltlskadyekhkvyacevthqglsspvtksfnrgec | SEQ ID<br>NO: 90 |
| Heavy<br>chain<br>B | evrlvesggglvkpggslrlscsasgfdfdnawmtwvrqppgkglewvg<br>ritgpgegwsvdyaesvkgrftisrdntkntlylemnnvrtedtgyyfcart<br>gkyydfwwgyppgeeyfqdwgqgftvivssdkthtqmqlqesgpglv<br>kpsetlsltcsvsgasisdsywswirrspgkglewigyvhksgdtnyspsl<br>ksrvnlsldtsknqvslslvaataadsgkyycartlhgrriygivafnewfty<br>fymdvwgngtqvtvssdkthtastkgpsvfplapssksstsggtaalgclvk<br>dyfpepvtvswnsgaltsgvhtfpavlqssglyslssvvtvpssslgtqtyic<br>nvnhkpsntkvdkkvepkscdkthtcppcpapellggpsvflfppkpkd<br>tlmisrtpevtcvvvdvshedpevkfnwyvdgvevhnaktkpreeqyns<br>tyrvvsvltvlhqdwlngkeykckvsnkalpapiektiskakgqprepqv<br>ytlppcrdeltknqvslwclvkgfypsdiavewesngqpennykttppvl<br>dsdgsfflyskltvdksrwqqgnvfscsvmhealhnhytqkslslspg | SEQ ID<br>NO: 91 |
| Light<br>chain<br>B | tsdisvapgetariscgekslgsravqwyqhragqapsliiynnqdrpsgiperfsgs<br>npdspfgttatltitsveagdeadyychiwdsrvptkwvfggttltvldkthtaselt<br>qdpavsvalkqtvtitcrgdslrshyaswyqkkpgqapvllfygknnrpsgipdrf<br>sgsasgnrasltitgaqaedeadyycssrdksgsrlsvfgggtkltvldkthtrtvaap<br>svfifppsdeqlksgtasvvcllnnfypreakvqwkvdnalqsgnsqesvteqds<br>kdstyslsstltlskadyekhkvyacevthqglsspvtksfnrgec | SEQ ID<br>NO: 92 |

TABLE 2-continued

Heavy and light chain sequences of binding proteins. CDR sequences are bolded and italicized.

Binding Protein 12 Nucleotide Sequences

| | | |
|---|---|---|
| Heavy chain A | agagcccacctggtgcagtctggcaccgccatgaagaaaccaggcgcctctgtgc ggtgtcctgtcagacaagcggctacaccttcaccgcccacatcctgttctggttccg gcaggcccctggcagaggactggaatgggtgggatggatcaagcccagtatggc gccgtgaacttcggcgaggcttccgggatagagtgaccctgacccgggacgtgta ccgcgagatcgcctacatggacatccggggcctgaagcccgatgacaccgccgtg tactactgcgccagagacagaagctacggcgacagcagctgggctctggatgctg gggcagggcacaaccgtggtgtctgccgcctctacaaagggcccagcgtg ttccctctggccccctagcagcaagagcacatctggcggaacagccgccctgggctg cctcgtgaaggactactttcccgagcccgtgaccgtgtcctggaattctggcgccctg accagcggcgtgcacaccttccagctgtgctgcagtccagcggcctgtacagcctg agcagcgtcgtgacagtgcccagcagctctctgggcacccagacctacatctgcaa cgtgaaccacaagcccagcaacaccaaggtggacaagaaggtggaacccaagag ctgcgacaagacccacacctgtccccttgtcctgccccgaactgctggaggcc cttccgtgttcctgttccccccaaagcccaaggacaccctgatgatcagccggaccc ccgaagtgacctgcgtggtggtggatgtgtcccacgaggaccctgaagtgaagttca attggtacgtggacggcgtggaagtgcacaacgccaagaccaagccaagagagg aacagtacaacagcacctaccgggtggtgtccgtgctgaccgtgctgcaccaggac tggctgaacggcaaagagtacaagtgcaaggtgtccaacaaggccctgcctgcccc catcgagaaaaccatcagcaaggccaagggccagccccgcgaacccaggtgtg cacactgccccaagcagggacgagctgaccaagaaccaggtgtccctgagctgt gccgtgaaaggcttctaccctccgatatcgccgtggaatgggagagcaacggcca gcccgagaacaactacaagaccaccccccctgtgctggacagcgacggctcattct tcctggtgtccaagctgacagtggacaagtcccgtggcagcagggcaacgtgttc agctgctccgtgatgcacgaggccctgcacaaccactacacccagaagtccctgag cctgagccccggcaag | SEQ ID NO: 93 |
| Light chain A | tacatccacgtgacccagagcccagcagcctgtccgtgtccatcggcgac agagtgaccatcaactgccagacctctcagggcgtgggcagcgacctgcac tggtatcagcacaagcctggcagagccccaagctgctgatccaccacaca agcagcgtggaagatggcgtgcccagcagattttccggcagcggcttccac accagcttcaacctgaccatcagcgatctgcaggccgacgacattgccacct actattgtcaggtgctgcagttcttcggcagaggcagcagactgcacatcaag cgtacggtggccgctcccagcgtgttcatcttcccacctagcgacgagcagc tgaagtccggcacagcctctgtcgtgtgcctgctgaacaacttctaccccgc gaggccaaagtgcagtggaaggtggacaacgccctgcagagcggcaaca gccaggaaagcgtgaccgagcaggacagcaaggactccacctacagcctg agcagcaccctgacactgagcaaggccgactacgagaagcacaaggtgta cgcctgcgaagtgacccaccagggcctgtctagccccgtgaccaagagctt caaccggggcgagtgt | SEQ ID NO: 94 |
| Heavy chain B | gaggttagactggtggagtcaggagggggcttgtgaagcccggtgggtctctccg cctgagctgttctgcctccggctttgatttcgataacgcctggatgacctgggtcaggc agcctccaggtaagggactggagtgggtgggaagaatcacaggtccaggcgagg gctggtccgtggactacgcggaatctgttaaagggcggtttacaatctcaagggaca ataccaagaataccttgtatttggagatgaacaacgtgagaactgaagacaccggat attacttctgtgccagaacaggcaaatactacgacttctggtggggctatccccctgg cgaggaatatttttcaagactggggtcagggaacccttgttatcgtgtcctccgacaaa acccataccagatgcagctgcaggagagcggccctggactcgtgaagcccagcg agacccctgagcctgacatgcagcgtgacggccgccagcatcagcgacagctactg gagctggatcaggaggagccctggcaagggcctggagtggatcggctacgtgcac aagagcggcgacaccaactacagccccctcctgaagtccagggtgaacctgtccct ggacaccagcaagaaccaggtgagcctgtccctggtggctgccacagctgctgac agcggcaagtactactgtgccaggaccctgcacggcaggaggatctacggcatcgt ggccttcaacgagtggttcacctacttctacatggacgtgtggggcaacggcaccca ggtgaccgtgagctccgataagacccacaccgcttccaccaagggccccatcggtctt cccctggcaccctcctccaagagcacctctggggcacagcggccctgggctgc ctggtcaaggactacttccccgaaccggtgacggtgtcgtggaactcaggcgccct gaccagcggcgtgcacaccttcccggctgtcctacagtcctcaggactctactccctc agcagcgtggtgaccgtgccctccagcagcttgggcacccagacctacatctgcaa cgtgaatcacaagcccagcaacaccaaggtggacaagaaagttgagcccaaatctt gtgacaaaactcacacatgcccaccgtgcccagcacctgaactcctggggggacc gtcagtcttcctcttccccccaaaacccaaggacaccctcatgatctcccggacccct gaggtcacatgcgtggtggtggacgtgagccacgaagaccctgaggtcaagttcaa ctggtatgttgacggcgtggaggtgcataatgccaagacaaagccgcgggaggag cagtacaacagcacgtaccgtgtggtcagcgtcctcaccgtcctgcaccaggactg gctgaatggcaaggagtacaagtgcaaggtctccaacaaagccctcccagccccca tcgagaaaaccatctccaaagccaaagggcagccccgagaaccacaggtgtacac cctgcccccatgccgggatgagctgaccaagaatcaagtcagcctgtggtgcctggt aaaaggcttctatcccagcgacatcgccgtggagtgggagagcaatgggcagccg gagaacaactacaagaccacgcctcccgtgctggactccgacggctccttcttcctct actcaaaactcaccgtggacaagagcaggtggcagcaggggaacgtcttctcatgc tccgtgatgcatgaggctctgcacaaccactacacgcagaagagcctctccctgtctc cgggt | SEQ ID NO: 95 |

TABLE 2-continued

Heavy and light chain sequences of binding proteins. CDR sequences are bolded and italicized.

| | | |
|---|---|---|
| Light chain B | ttccgacatcagcgtggccccggagagacagccaggatctcctgcggcga aagagcctgggaagcagggctgtgcagtggtaccaacacagggccgga caggctcccagcctgatcatctacaacaaccaggacaggcccagcggcatc cctgagaggttcagcggaagccccgacagccccttcggaaccacagccac cctgaccatcacaagcgtggaagccggcgacgaggccgactactactgcc acatctgggacagcagggtgcccaccaagtgggtgtttggcggcggcacca ccctgaccgtgctggacaaaacccataccgcatccgaactgactcaggacc ctgccgtctctgtggcactgaagcagactgtgactattacttgccgaggcgac tcactgcggagccactacgcttcctggtatcagaagaaacccggccaggca cctgtgctgctgttctacgaaagaacaataggccatctggcatccccgacc gcttttctggcagtgcatcagggaaccgagccagtctgaccattaccggcgc caggctgaggacgaagccgattactattgcagctcccgggataagagcgg ctccagactgagcgtgttcggaggaggaactaaactgaccgtcctcgataag acccataccgtacggtggccgctcccagcgtgttcatcttcccacctagcga cgagcagctgaagtccggcacagcctctgtcgtgtgcctgctgaacaacttct accccgcgaggccaaagtgcagtggaaggtggacaacgccctgcagag cggcaacagccaggaaagcgtgaccgagcaggacagcaaggactccacc tacagcctgagcagcaccctgacactgagcaaggccgactacgagaagca caagtgtacgcctgcgaagtgacccaccagggcctgtctagccccgtgac caagagcttcaaccggggcgagtgt | SEQ ID NO: 96 |

Binding Protein 13 Amino Acid Sequences

| | | |
|---|---|---|
| Heavy chain A | qvhltqsgpevrkpgtsvkvsckapgntlktydlhwvrsvpgqglqwmgwis hegdkkviverfkakvtidwdrstntaylqlsgltsgdtavyycakgskhrlrdyal ydddgalnwavdvdylsnlefwgqgtavtvss*astkgpsvfplapsskstsggta algclvkdyfpepvtvswnsqaltsgvhtfpavlqssglyslssvvtvpssslqtqt vicnvnhkpsntkvdkkvepkscdkthtcppcpapellggpsvflfppkpkdtl misrtpevtcvvvdvshedpevkfnwyvdgvevhnaktkpreeqynstyrvvs vltvlhqdwlngkeykckvsnkalpapiektiskakgqprepqvctlppsrdelt knqvslscavkgfypsdiavewesnqqpennykttppvldsdgsfflvskltvdk srwqqgnvfscsvmhealhnhytqkslslspg* | SEQ ID NO: 97 |
| Light chain A | dfvltqsphslsvtpgesasisckssshslihgdrnnylawyvqkpgrspqlliylas srasgvpdrfsgsgsdkdftlkisrvetedvgtyycmqgrespwtfgqgtkvdikr tvaapsvfifppsdeqlksgtasvvcllnnfypreakvqwkvdnalqsgnsqesv teqdskdstyslsstltlskadyekhkvyacevthqglsspvtksfnrgec | SEQ ID NO: 98 |
| Heavy chain B | evrlvesgglvkpggslrlscsasgfdfdnawmtwvrqppgkglewv ngritgpgegwsvdyaesvkgrftisrdntkntlylemnnvrtedtgyyfca rtgkyydfwgyppgeeyfqdwgqgtlvivssdkthtqmlqesgpgl vkpsetlsltcsvsgasisdsywswirrspgkglewigyvhksgdtnysps lksrvnlsldtsknqvslslvaataadsgkyycartlhgrriygivafnewft yfymdvwgngtqvtvssdkthtastkgpsvfplapsskstsggtaalgclv kdyfpepvtvswnsgaltsgvhtfpavlqssglyslssvvtvpssslgtqty icnvnhkpsntkvdkkvepkscdkthtcppcpapellggpsvflfppkp kdtlmisrtpevtcvvvdvshedpevkfnwyvdgvevhnaktkpreeq ynstyrvvsvltvlhqdwlngkeykckvsnkalpapiektiskakgqpre pqvytlppcrdeltknqvslwclvkgfypsdiavewesngqpennyktt ppvldsdgsfflyskltvdksrwqqgnvfscsvmhealhnhytqkslsls pg | SEQ ID NO: 99 |
| Light chain B | sdisvapgetariscgekslgsravqwyqhragqapsliiynnqdrpsgiperfsg spdspfgttatltitsveagdeadyychiwdsrvptkwvfggtltvldkthtasel tqdpavsvalkqtvtitcrgdslrshyaswyqkkpgqapvllfygknnrpsgipdr fsgsasgnrasltitgaqaedeadyycssrdksgsrlsvfggtkltvldkthtrtvaa psvfifppsdeqlksgtasvvcllnnfypreakvqwkvdnalqsgnsqesvteqd skdstyslsstltlskadyekhkvyacevthqglsspvtksfnrgec | SEQ ID NO: 100 |

Binding Protein 13 Nucleotide Sequences

| | | |
|---|---|---|
| Heavy chain A | caggtgcacctgacacagagcggacccgaagtgcggaagcctggcacctctgtga aggtgtcctgcaaggcccctggcaacaccctgaaaacctacgacctgcactgggtg cgcagcgtgccaggacagggactgcagtggatgggctggatcagccacgagggc gacaagaaagtgatcgtggaacggttcaaggccaaagtgaccatcgactgggaca gaagcaccaacaccgcctacctgcagctgagcggcctgacctctggcgataccgc cgtgtactactgcgccaagggcagcaagcacggctgagagactacgccctgtac gacgatggcgcgccctgaactgggccgtggatgtggactacctgagcaacctgg aattctgggcagggcacagccgtgaccgtgtcatctgcttcgaccaagggcccc agcgtgttccctctggcccctagcagcaagagcacatctggcggaacagccgccct gggctgcctcgtgaaggactactttcccgagcccgtgaccgtgtcctggaattctgg cgccctgaccagcggcgtgcacaccttcccagctgtgctgcagtccagcggcctgt acagcctgagcagcgtcgtgacagtgcccagcagctctctgggcacccagaccta catctgcaacgtgaaccacaagcccagcaacaccaaggtggacaagaaggtggga acccaagagctgcgacaagacccacacctgtcccccttgtcctgcccccgaactgc tgggaggcccttccgtgttcctgttcccccccaaagcccaaggacaccctgatgatca gccggacccccgaagtgacctgcgtggtggtggatgtgtcccacgaggaccctga | SEQ ID NO: 101 |

TABLE 2-continued

Heavy and light chain sequences of binding proteins. CDR sequences are bolded and italicized.

| | | |
|---|---|---|
| | agtgaagttcaattggtacgtggacggcgtggaagtgcacaacgccaagaccaag ccaagagaggaacagtacaacagcacctacccgggtggtgtccgtgctgaccgtgct gcaccaggactggctgaacggcaaagagtacaagtgcaaggtgtccaacaaggc cctgcctgcccccatcgagaaaaccatcagcaaggccaagggccagccccgcga acccaggtgtgcacactgcccccaagcagggacgagctgaccaagaaccaggt gtccctgagctgtgccgtgaaaggcttctacccctccgatatcgccgtggaatggga gagcaacgccagcccgagaacaactacaagaccaccccccctgtgctggacag cgacggctcattcttcctggtgtccaagctgacagtggacaagtcccggtggcagca gggcaacgtgttcagctgctccgtgatgcacgaggccctgcacaaccactacaccc agaagtccctgagcctgagcccggcaag | |
| Light chain A | gacttcgtgctgacccagagccctcacagcctgagcgtgacacctggcgagagcg ccagcatcagctgcaagagcagccactccctgatccacggcgaccggaacaacta cctggcttggtacgtgcagaagcccggcagatccccccagctgctgatctacctgg ccagcagcagagccagcggcgtgcccgatagattttctggcagcggcagcgacaa ggacttcaccctgaagatcagccgggtggaaaccgaggacgtgggcacctactact gtatgcagggcagagagagccctggacctttggccagggcaccaaggtggacat caagcgtacggtggccgctcccagcgtgttcatcttcccacctagcgacgagcagct gaagtccggcacagcctctgtcgtgtgcctgctgaacaacttctaccccgcgaggc caaagtgcagtggaaggtggacaacgccctgcagagcggcaacagccaggaaa gcgtgaccgagcaggacagcaaggactccacctacagcctgagcagcaccctga cactgagcaaggccgactacgagaagcacaaggtgtacgcctgcgaagtgaccca ccagggcctgtctagccccgtgaccaagagcttcaaccggggcgagtgt | SEQ ID NO: 102 |
| Heavy chain B | gaggttagactggtggagtcaggaggggggcttgtgaagcccggtgggtctctccg cctgagctgttctgcctccggctttgatttcgataacgcctggatgacctgggtcaggc agcctccaggtaagggactggagtgggtgggaagaatcacaggtccaggcgagg gctggtccgtggactacgcggaatctgttaaagggcggtttacaatctcaagggaca ataccaagaataccttgtatttggagatgaacaacgtgagaactgaagacaccggat attacttctgtgccagaacaggcaaatactacgacttctggtggggctatcccctgg cgaggaatattttcaagactgggtcagggaacccttgttatcgtgtcctccgacaaa accatacccagatgcagctgcaggagagcggccctggactcgtgaagcccagc gagaccctgagcctgacatgcagcgtgagcggcgccagcatcagcgacagctact ggagctggatcaggaggagccctggcaagggcctggagtggatcggctacgtgc acaagagcggcgacaccaactacagcccctcccctgaagtcaccaggtgaacctgtc cctggacaccagcaagaaccaggtgagcctgtccctggtggctgccacagctgctg acagcggcaagtactactgtgccaggaccctgcacggcaggaggatctacggcat cgtggccttcaacgagtggttcacctacttctacatggacgtgtggggcaacggcac ccaggtgaccgtgagctccgataagacccacaccgcttccaccaagggcccatcg gtcttccccctggcaccctcctccaagagcacctctgggggcacagcggccctggg ctgcctggtcaaggactacttccccgaaccggtgacggtgtcgtggaactcaggcg ccctgaccagcggcgtgcacaccttcccggctgtcctacagtcctcaggactctact ccctcagcagcgtggtgaccgtgccctccagcagcttgggcacccagacctacatc tgcaacgtgaatcacaagcccagcaacaccaaggtggacaagaaagttgagccca aatcttgtgacaaaactcacacatgccccaccgtgcccagcacctgaactcctggggg gaccgtcagtcttcctcttccccccaaaacccaaggacaccctcatgatctcccgga cccctgaggtcacatgcgtggtggtggacgtgagccacgaagaccctgaggtcaa gttcaactggtatgttgacggcgtggaggtgcataatgccaagacaaagccgcggg aggagcagtacaacagcacgtaccgtgtggtcagcgtcctcaccgtcctgcaccag gactggctgaatggcaaggagtacaagtgcaaggtctccaacaaagcccttccag cccccatcgagaaaaccatctccaaagccaaagggcagccccgagaaccacagg tgtacaccctgcccccatgccgggatgagctgaccaagaatcaagtcagcctgtggt gcctggtaaaaggcttctatcccagcgacatcgccgtggagtgggagagcaatggg cagccggagaacaactacaagaccacgcctcccgtgctggactccgacggctcctt cttcctctactcaaaactcaccgtggacaagagcaggtggcagcaggggaacgtctt ctcatgctccgtgatgcatgaggctctgcacaaccactacacgcagaagagcctctc cctgtctccgggt | SEQ ID NO: 103 |
| Light chain B | ttccgacatcagcgtggcccccggagagacagccaggatctcctgcggcga aagagcctgggaagcagggctgtgcagtggtaccaacacagggccgga caggctcccagcctgatcatctacaacaaccaggacaggcccagcggcatc cctgagaggttcagcggaagccccgacagcccttcggaaccacagccac cctgaccatcacaagcgtggaagccggcgacgaggccgactactactgcc acatctgggttcagcagggtgcccaccaagtgggtgtttggcggcggcacc accctgaccgtgctggacaaaacccataccgcatccgaactgactcaggac cctgccgtctctgtggcactgaagcagactgtgactattacttgccgaggcga ctcactgcggagccactacgcttcctggtatcagaagaaacccggccaggc acctgtgctgctgttctacggaaagaacaataggccatctggcatccccgac cgcttttctggcagtgcatcagggaaccgagccagtctgaccattaccggcg cccaggctgaggacgaagccgattactattgcagctcccgggataagagcg gctccagactgagcgtgttcggaggaggaactaaactgaccgtcctcgataa gacccataccgtacggtggccgctcccagcgtgttcatcttcccacctagc gacgagcagctgaagtccggcacagcctctgtcgtgtgcctgctgaacaact tctaccccgcgaggccaaagtgcagtggaaggtggacaacgccctgcag agcggcaacagccaggaaagcgtgaccgagcaggacagcaaggactcca | SEQ ID NO: 104 |

TABLE 2-continued

Heavy and light chain sequences of binding proteins. CDR sequences are bolded and italicized.

```
cctacagcctgagcagcaccctgacactgagcaaggccgactacgagaag
cacaaggtgtacgcctgcgaagtgacccaccagggcctgtctagccccgtg
accaagagcttcaaccggggcgagtgt
```

Binding Protein 14 Amino Acid Sequences

| | | |
|---|---|---|
| Heavy chain A | Rahlvqsgtamkkpgasvrvscqtsgytftahilfwfrqapgrglewvgwikpq nygavnfgggfrdrvtltrdvyreiaymdirglkpddtavyycardrsygdsswal dawgqgttvvvsaastkgpsvfplapssksstsggtaalgclvkdyfpepvtvswn sgaltsgvhtfpavlqssglyslssvvtvpssslgtqtyicnvnhkpsntkvdkkve pkscdkthtcppcpapellggpsvflfppkpkdtlmisrtpevtcvvvdvshedp evkfnwyvdgvevhnaktkpreeqynstyrvvsvltvlhqdwlngkeykckv snkalpapiektiskakgqprepqvctlppsrdeltknqvslscavkgfypsdiav ewesngqpennykttppvldsdgsfflvskftvdksrwqqgnvfscsvmheal hnhytqkslslspg | SEQ ID NO: 105 |
| Light chain A | yihvtqspsslsvsigdrvtincqtsqgvgsdlhwyqhkpgrapkllihhtssved sgsgfhtsfnltisdlqaddiatyycqvlqffgrgsrlhikrtvaapsvfifp psdeqlksgtasvvcllnnfypreakvqwkvdnalqsgnsqesvteqdskdsty slsstltlskadyekhkvyacevthqglsspvtksfnrgec | SEQ ID NO: 106 |
| Heavy chain B | Qvhltqsgpevrkpgtsvkvsckapgntlktydlhwvrsvpgqglqwm gwishegdkkviverfkakvtidwdrstntaylqlsgltsgdtavyycakg skhrlrdyalydddgalnwavdvdylsnlefwgqgtavtvssdkthtevrl vesggglvkpggslrlscsasgfdfdnawmtwvrqppgkglewvgritg pgegwsvdyaesvkgrftisrdntkntlylemnnvrtedtgyyfcartgky ydfwwgyppgeeyfqdwgqgtlvivssdkthtastkgpsvfplapssks tsggtaalgclvkdyfpepvtvswnsgaltsgvhtfpavlqssglyslssvv tvpssslgtqtyicnvnhkpsntkvdkkvepkscdkthtcppcpapellg gpsvflfppkpkdtlmisrtpevtcvvvdvshedpevkfnwyvdgvev hnaktkpreeqynstyrvvsvltvlhqdwlngkeykckvsnkalpapiek tiskakgqprepqvytlppcrdeltknqvslwclvkgfypsdiavewesn gqpennykttppvldsdgsfflyskltvdksrwqqgnvfscsvmhealh nhytqkslslspg | SEQ ID NO: 107 |
| Light chain B | aseltqdpavsvalkqtvtitcrgdslrshyaswyqkkpgqapvllfygknnrpsg nipdrfsgsasgnrasltitgaqaedeadyycssrdksgsrlsvfgggtkltvldktht dfvltqsphslsvtpgesasiscksshslihgdrnnylawyvqkpgrspqlliylas srasgvpdrfsgsgsdkdftlkisrvetedvgtyycmqgrespwtfgqgtkvdik dkthtrtvaapsvfifppsdeqlksgtasvvcllnnfypreakvqwkvdnalqsg nsqesvteqdskdstyslsstltlskadyekhkvyacevthqglsspvtksfnrgec | SEQ ID NO: 108 |

Binding Protein 14 Nucleotide Sequences

| | | |
|---|---|---|
| Heavy chain A | agagcccacctggtgcagtctggcaccgccatgaagaaaccaggcgcctctgtgc gggtgtcctgtcagacaagcggctacaccttcaccgcccacatcctgttctggttccg gcaggcccctggcagaggactggaatgggtgggatggatcaagccccagtatggc gccgtgaacttcggcggaggcttccgggatagagtgaccctgacccgggacgtgt accgcgagatcgcctacatggacatccggggcctgaagcccgatgacaccgccgt gtactactgcgccagagacagaagctacggcgacagcagctgggctctggatgctt ggggccagggcacaacgtggtggtgtctgccgcctctacaaaagggcccagcgt gttccctctggcccctagcagcaagagcacatcggcggaacagccgcctgggct gcctcgtgaaggactactttcccgagcccgtgaccgtgtcctggaattctggcgccct gaccagcggcgtgcacacctttccagctgtgctgcagtccagcggcctgtacagcc tgagcagcgtcgtgacagtgcccagcagctctctgggcacccagacctacatctgc aacgtgaaccacaagcccagcaacaccaaggtggacaagaaggtggaaccaag agctgcgacaagacccacacctgtcccccttgtcctgcccccgaactgctgggagg cccttccgtgttcctgttccccccaaagcccaaggacaccctgatgatcagccggac ccccgaagtgacctgcgtggtggtggatgtgtcccacgaggaccctgaagtgaagt tcaattggtacgtggacggcgtggaagtgcacaacgccaagaccaagccaagaga ggaacagtacaacagcacctaccgggtggtgtccgtgctgaccgtgctgcaccag gactggctgaacggcaaagagtacaagtgcaaggtgtccaacaaggccctgcctg cccccatcgagaaaaccatcagcaaggccaagggccagccccgcgaaccccag gtgtgcacactgccccaagcagggacgagctgaccaagaaccaggtgtccctga gctgtgccgtgaaaggcttctacccctccgatatcgccgtggaatgggagagcaac ggccagcccgagaacaactacaagaccacccccctgtgctggacagcgacggc tcattcttcctggtgtccaagctgacagtggacaagtcccggtggcagcagggcaac gtgttcagctgctccgtgatgcacgaggccctgcacaaccactacacccagaagtc cctgagcctgagcccggcaag | SEQ ID NO: 109 |
| Light chain A | ttacatccacgtgacccagagccccagcagcctgtccgtgtccatcggcgac agagtgaccatcaactgccagacctctcagggcgtgggcagcgacctgcac tggtatcagcacaagcctggcagagcccccaagctgctgatccaccacaca agcagcgtggaagatgcgtgcccagcagattttccggcagcggcttccac accagcttcaacctgaccatcagcgatctgcaggccgacgacattgccacct actattgtcaggtgctgcagttcttcggcagaggcagcagactgcacatcaa gcgtacggtggccgctcccagcgtgttcatcttcccacctagcgacgagcag | SEQ ID NO: 110 |

TABLE 2-continued

Heavy and light chain sequences of binding proteins. CDR sequences are bolded and italicized.

| | | |
|---|---|---|
| | ctgaagtccggcacagcctctgtcgtgtgcctgctgaacaacttctaccccg cgaggccaaagtgcagtggaaggtggacaacgccctgcagagcggcaac agccaggaaagcgtgaccgagcaggacagcaaggactccacctacagcct gagcagcaccctgacactgagcaaggccgactacgagaagcacaaggtgt acgcctgcgaagtgacccaccagggcctgtctagccccgtgaccaagagct tcaaccggggcgagtgt | |
| Heavy chain B | caggtgcacctgacacagagcggacccgaagtgcggaagcctggcacctctgtga aggtgtcctgcaaggcccctggcaacaccctgaaaacctacgacctgcactgggtg cgcagcgtgccaggacagggactgcagtggatgggctggatcagccacgagggc gacaagaaagtgatcgtggaacggttcaaggccaaagtgaccatcgactgggaca gaagcaccaacaccgcctacctgcagctgagcggcctgacctctggcgataccgc cgtgtactactgcgccaagggcagcaagcaccggctgagagactacgccctgtac gacgatgacggcgccctgaactgggcgtggatgtggactacctgagcaacctgg aattctggggccagggcacagccgtgaccgtgtcatctgacaaaacccataccgag gttagactggtggagtcaggagggggcttgtgaagcccggtgggtctctccgcct gagctgactgcctccggctttgatttcgataacgcctggatgacctgggtcaggcag cctccaggtaagggactggagtgggtgggaagaatcacaggtccaggcgagggc tggtccgtggactacgcggaatctgttaaagggcggtttacaatctcaagggacaat accaagaataccttgtatttggagatgaacaacgtgagaactgaagacaccggatatt acttctgtgccagaacaggcaaatactacgacttctggtggggctatcccctggcg aggaatattttaagactggggtcagggaacccttgttatcgtgtcctccgataagac ccacaccgcttccaccaagggccatcggtcttcccctggcaccctcctccaaga gcacctctgggggcacagcggccctgggctgcctggtcaaggactacttccccga accggtgacggtgtcgtggaactcaggcgccctgaccagcggcgtgcacaccttc ccggctgtcctacagtcctcaggactctactccctcagcagcgtggtgaccgtgccc tccagcagcttgggcacccagacctacatctgcaacgtgaatcacaagcccagca ccaaggtggacaagaaagttgagcccaaatcttgtgacaaaactcacacatgcc caccgtgcccagcacctgaactcctggggggaccgtcagtcttcctcttccccccaa aacccaaggacaccctcatgatctcccggacccctgaggtcacatgcgtggtggtg gacgtgagccacgaagaccctgaggtcaagttcaactggtatgtgacggcgtgga ggtgcataatgccaagacaaagccgcgggaggagcagtacaacagcacgtaccg tgtggtcagcgtcctcaccgtcctgcaccaggactggctgaatggcaaggagtaca agtgcaaggtctccaacaaagcctcccagccccatcgagaaaaccatctctccaaa gccaaagggcagccccgagaaccacaggtgtacaccctgcccccatgccgggat gagctgaccaagaatcaagtcagcctgtggtgcctggtaaaaggcttctatcccagc gacatcgccgtggagtgggagagcaatgggcagccggagaacaactacaagacc acgcctcccgtgctggactccgacggctccttcttcctctactcaaaactcaccgtgg acaagagcaggtggcagcaggggaacgtcttctcatgctccgtgatgcatgaggct ctgcacaaccactacacgcagaagagcctctccctgtctccgggt | SEQ ID NO: 111 |
| Light chain B | gcatccgaactgactcaggaccctgccgtctctgtggcactgaagcagactg tgactattacttgccgaggcgactcactgcggagccactacgcttcctggtat cagaagaaacccggccaggcacctgtgctgctgttctacggaaagaacaat aggccatctggcatccccgaccgcttttctggcagtgcatcagggaaccgag ccagtctgaccattaccggcgcccaggctgaggacgaagccgattactattg cagctcccgggataagagcggctccagactgagcgtgttcggaggaggaa ctaaactgaccgtcctcgacaaaacccataccgacttcgtgctgacccagag ccctcacagcctgagcgtgacacctggcgagagcgccagcatcagctgca gagcagccactccctgatccacggcgaccggaacaactacctggcttggt acgtgcaagcccggcagatccccccagctgctgatctacctggccagca gcagagccagcggcgtgcccgatagatttctggcagcggcagcgacaag gacttcacccctgaagatcagccgggtggaaaccgaggacgtgggcaccta ctactgtatgcagggcagagagagcccctggacctttggccagggcaccaa ggtggacatcaaggataagaccatacccgtacggtggccgctcccagcgt gttcatcttcccacctagcgacgagcagctgaagtccggcacagcctctgtc gtgtgcctgctgaacaacttctaccccgcgaggccaaagtgcagtggaag gtggacaacgccctgcagagcggcaacagccaggaaagcgtgaccgagc aggacagcaaggactccacctacagcctgagcagcaccctgacactgagc aaggccgactacgagaagcacaaggtgtacgcctgcgaagtgacccacca gggcctgtctagccccgtgaccaagagcttcaaccggggcgagtgt | SEQ ID NO: 112 |

Binding Protein 15 Amino Acid Sequences

| | | |
|---|---|---|
| Heavy chain A | qvhltqsgpevrkpgtsvkvsckapgntlktydlhwvrsvpgqglqwmgwish negdkkviverfkakvtidwdrstntaylqlsgltsgdtavyycakgskhrlrdyaly dddgalnwavdvdylsnlefwgqgtavtvssastkgpsvfplapssktsggtaal gclvkdyfpepvtvswnsgaltsgvhtfpavlqssglyslssvvtvpssslgtqtyi cnvnhkpsntkvdkkvepkscdkthtcppcpapellggpsvflfppkpkdtlmi srtpevtcvvvdvshedpevkfnwyvdgvevhnakttkpreeqynstyrvvsvlt vlhqdwlngkeykckvsnkalpapiektiskakgqprepqvctlppsrdeltknq vslscavkgfypsdiavewesngqpennykttppvldsdgsfflvskltvdksrw qqgnvfscsvmhealhnhytqkslslspg | SEQ ID NO: 113 |

TABLE 2-continued

Heavy and light chain sequences of binding proteins. CDR sequences are bolded and italicized.

| | | |
|---|---|---|
| Light chain A | tdfvltqspslsvtpgesasisckssbslihgdrnnylawyvqkpgrspqlliylass rasgvpdrfsgsgsdkdftlkisrvetedvgtyycmqgrespwtfgqgtkvdikrt vaapsvfifppsdeqlksgtasvvcllnnfypreakvqwkvdnalqsgnsqesvt eqdskdstyslsstltlskadyekhkvyacevthqglsspvtksfnrgec | SEQ ID NO: 114 |
| Heavy chain B | Evrlvesggglvkpggslrlscsasgfdfdnawmtwvrqppgkglewv ingritgpgegwsvdyaesvkgrftisrdntkntlylemnnvrtedtgyyfcar tgkyydfwsgyppgeeyfqdwgqgtlvivssdkthtqmlqesgpglv kpsetlsltcsvsgasisdsywswirrspgkglewigyvhksgdtnyspsl ksrvnlsldtsknqvslslvaataadsgkyycartlhgrriygivafnewfty fymdvwgngtqvtvssdkthtastkgpsvfplapsskstsggtaalgclvk dyfpepvtvswnsgaltsgvhtfpavlqssglyslssvvtvpssslgtqtyic nvnhkpsntkvdkkvepkscdkthtcppcpapellggpsvflfppkpkd tlmisrtpevtcvvvdvshedpevkfnwyvdgvevhnakktkpreeqyns tyrvvsvltvlhqdwlngkeykckvsnkalpapiektiskakgqprepqv ytlppcrdeltknqvslwclvkgfypsdiavewesngqpennykttppvl dsdgsfflyskltvdksrwqqgnvfscsvmhealhnhytqkslslspg | SEQ ID NO: 115 |
| Light chain B | sdisvapgetariscgekslgsravqwyqhragqapsliiynnqdrpsgiperfsgs pdspfgttatltitsveagdeadyychiwdsrvptkwvfgggttltvldkthtaselt qdpavsvalkqtvtitcrgdslrshyaswyqkkpgqapvllfygknnrpsgipdrf sgsasgnrasltitgaqaedeadyycssrdksgsrlsvfgggtkltvldkthtrtvaap svfifppsdeqlksgtasvvcllnnfypreakvqwkvdnalqsgnsqesvteqds kdstyslsstltlskadyekhkvyacevthqglsspvtksfnrgec | SEQ ID NO: 116 |

Binding Protein 15 Nucleotide Sequences

| | | |
|---|---|---|
| Heavy chain A | caggtgcacctgacacagagcggaccegaagtgcggaagcctggcacctctgtga aggtgtcctgcaaggccectggcaacaccctgaaaacctacgacctgcactgggtg cgcagcgtgccaggacagggactgcagtgatgggctggatcagccacgagggc gacaagaaagtgatcgtggaacggttcaaggccaaagtgaccatcgactgggaca gaagcaccaacaccgcctacctgcagctgagcggcctgacctctggcgataccgc cgtgtactactgcgccaagggcagcaagaccggctgagagactacgccctgtac gacgatgacggcgccctgaactgggccgtggatgtggactacctgagcaacctgg aattctgggcagggcacagccgtgaccgtgtcatctgcttcgaccaagggcccc agcgtgttccctctggcccctagcagcaagagcacatctggcggaacagccgcct gggctgcctcgtgaaggactactttccegagccegtgaccgtgtcctggaattctggc gccctgaccagcggcgtgcacacctttccagctgtgctgcagtccagcggcctgtac agcctgagcagcgtcgtgacagtgcccagcagctctctgggcacccagacctacat ctgcaacgtgaaccacaagcccagcaacaccaaggtggacaagaaggtggaacc caagagctgcgacaagacccacacctgtcccccttgtcctgcccccgaactgctgg gaggccctcegtgttcctgttcccccaaagcccaaggacaccctgatgatcagcc ggaccccgaagtgacctgcgtggtggtggatgtgtcccacgaggaccctgaagtg aagttcaattggtacgtggacggcgtggaagtgcacaacgccaagaccaagccaa gagaggaacagtacaacagcacctaccgggtggtgtccgctgaccgtgctgcac caggactggctgaacggcaaagagtacaagtgcaaggtgtccaacaaggccctgc ctgcccccatcgagaaaaccatcagcaaggccaagggccagcccccgcgaaccec aggtgtgcacactgcccccaagcagggacgagctgaccaagaaccaggtgtccct gagctgtgccgtgaaaggcttctaccccctccgatatcgccgtggaatgggagagca acggccagcccgagaacaactacaagaccacccccctgtgctggacagcgacg gctcattcttcctggtgtccaagctgacagtggacaagtcccggtggcagcagggca acgtgttcagctgctccgtgatgcacgaggccctgcacaaccactacacccagaagt ccctgagcctgagccccggcaag | SEQ ID NO: 117 |
| Light chain A | gacttcgtgctgacccagagccctcacagcctgagcgtgacacctggcgagagcg ccagcatcagctgcaagagcagccactccctgatccacggcgaccggaacaacta cctggcttggtacgtgcagaagcccggcagatccccccagctgctgatctacctggc cagcagcagagccagcggcgtgcccgatagattttctggcagcggcagcgacaag gacttcacccctgaagatcagccgggtggaaaccgaggacgtgggcacctactactg tatgcagggcagagagagccectggacctttggccagggcaccaaggtggacatc aagcgtacggtggccgctcccagcgtgttcatcttcccacctagcgacgagcagctg aagtccggcacagcctctgtcgtgtgcctgctgaacaacttctaccccgcgaggcc aaagtgcagtggaaggtggacaacgccctgcagagcggcaacagccaggaaagc gtgaccgagcaggacagcaaggactccaccctacagcctgagcagcaccctgacac tgagcaaggccgactacgagaagcacaaggtgtacgcctgcgaagtgacccacca gggcctgtctagccccgtgaccaagagcttcaaccggggcgagtgt | SEQ ID NO: 118 |
| Heavy chain B | gaggttagactggtggagtcaggagggggcttgtgaagccegtgggtctctccg cctgagctgttctgcctccggctttgatttcgataacgcctggatgacctgggtcaggc agcctccaggtaagggactggagtgggtgggaagaatcacaggtccaggcgagg gctggtccgtggactacgcggaatctgttaaagggcggtttacaatctcaagggaca ataccaagaataccttgtatttggagataacaacgtgagaactgaagacaccggat attacttctgtgccagaacaggcaaatactacgacttctggtccggctatcccctggc gaggaatattttcaagactggggtcagggaacccttgttatcgtgtcctccgacaaaa cccataccagatgcagctgcaggagagcggccctggactcgtgaagcccagcga gaccctgagcctgacatgcagcgtgagcggcgccagcatcagcgacagctactgg agctggatcaggaggagccctggcaagggcctggagtggatcggctacgtgcaca | SEQ ID NO: 119 |

TABLE 2-continued

Heavy and light chain sequences of binding proteins. CDR sequences are bolded and italicized.

|  |  |  |
|---|---|---|
|  | agagcggcgacaccaactacagcccctccctgaagtccagggtgaacctgtccctg<br>gacaccagcaagaaccaggtgagcctgtccctggtggctgccacagctgctgaca<br>gcggcaagtactactgtgccaggaccctgcacggcaggaggatctacggcatcgtg<br>gccttcaacgagtggttcacctacttctacatggacgtgtggggcaacggcacccag<br>gtgaccgtgagctccgataagacccacaccgcttccaccaagggcccatcggtcttc<br>cccctggcaccctcctccaagagcacctctggggggcacagcggccctgggctgcct<br>ggtcaaggactacttccccgaaccggtgacggtgtcgtggaactcaggcgccctga<br>ccagcggcgtgcacaccttcccggctgtcctacagtcctcaggactctactccctcag<br>cagcgtggtgaccgtgcctccagcagcttgggcacccagacctacatctgcaacg<br>tgaatcacaagcccagcaacaccaaggtggacaagaaagttgagcccaaatcttgt<br>gacaaaactcacacatgcccaccgtgcccagcacctgaactcctggggggaccgtc<br>agtcttcctcttccccccaaaacccaaggacaccctcatgatctcccggacccctgag<br>gtcacatgcgtggtggtggacgtgagccacgaagaccctgaggtcaagttcaactg<br>gtatgttgacggcgtggaggtgcataatgccaagacaaagccgcgggaggagcag<br>tacaacagcacgtaccgtgtggtcagcgtcctcaccgtcctgcaccaggactggctg<br>aatggcaaggagtacaagtgcaaggtctccaacaaagccctcccagcccccatcga<br>gaaaaccatctccaaagccaaagggcagccccgagaaccacaggtgtacaccctg<br>cccccatgcccgggatgagctgaccaagaatcaagtcagcctgtggtgcctggtaaa<br>aggcttctatcccagcgacatcgccgtggagtgggagagcaatgggcagccggag<br>aacaactacaagaccacgcctcccgtgctggactccgacggctccttcttcctctact<br>caaaactcaccgtggacaagagcaggtggcagcaggggaacgtcttctcatgctcc<br>gtgatgcatgaggctctgcacaaccactacacgcagaagagcctctccctgtctccg<br>ggt |  |
| Light<br>chain<br>B | ttccgacatcagcgtggcccccggagagacagccaggatctcctgcggcga<br>agaagagcctgggaagcagggctgtgcagtggtaccaacacaggccgga<br>caggctcccagcctgatcatctacaacaaccaggacaggcccagcggcatc<br>cctgagaggttcagcggaagccccgacagccccttcggaaccacagccac<br>cctgaccatcacaagcgtggaagccggcgacgaggccgactactactgcc<br>acatctgggacagcagggtgccccaccaagtgggtgtttggcggcggcacca<br>ccctgaccgtgctggacaaaacccataccgcatccgaactgactcaggacc<br>ctgccgtctctgtggcactgaagcagactgtgactattacttgccgaggcgac<br>tcactgcggagccactacgcttcctggtatcagaagaaacccggccaggca<br>cctgtgctgctgttctacggaaagaacaataggccatctggcatccccgacc<br>gcttttctggcagtgcatcagggaaccgagccagtctgaccattaccggcgc<br>ccaggctgaggacgaagccgattactattgcagctcccgggataagagcgg<br>ctccagactgagcgtgttcggaggaggaactaaactgaccgtcctcgataag<br>acccataccgtacggtggccgctcccagcgtgttcatcttcccacctagcga<br>cgagcagctgaagtccggcacagcctctgtcgtgtgcctgctgaacaacttct<br>acccccgcgaggccaaagtgcagtggaaggtggacaacgccctgcagag<br>cggcaacagccaggaaagcgtgaccgagcaggacagcaaggactccacc<br>tacagcctgagcagcaccctgacactgagcaaggccgactacgagaagca<br>aaggtgtacgcctgcgaagtgaccccaccagggcctgtctagccccgtgac<br>caagagcttcaaccggggcgagtgt | SEQ ID<br>NO: 120 |

Binding Protein 16 Amino Acid Sequences

| Heavy<br>chain<br>A | Rahlvqsgtamkkpgasvrvscqtsgytftahilfwfrqapgrglewvgwikpq<br>ygavnfgggfrdrvtltrdvyreiaymdirglkpddtavyycardrsygdsswal<br>dawgqgttvvvsaastkgpsvfplapsskstsggtaalgclvkdyfpepvtvswn<br>sgaltsgvhtfpavlqssglyslssvvtvpssslgtqtyicnvnhkpsntkvdkkve<br>pkscdkthtcppcpapellggpsvflfppkpkdtlmisrtpevtcvvvdvshedp<br>evkfnwyvdgvevhnaktkpreeqynstyrvvsvltvlhqdwlngkeykckvs<br>nkalpapiektiskakgqprepqvctlppsrdeltknqvslscavkgfypsdiave<br>wesngqpennykttppvldsdgsfflvskltvdksrwqqgnvfscsvmhealhn<br>hytqkslslspg | SEQ ID<br>NO: 121 |
| Light<br>chain<br>A | tyihvtqspsslsvsigdrvtincqtsqgvgsdlhwyqhkpgrapkllihhtssved<br>gvpsrfsgsgfhtsfnltisdlqaddiatyycqvlqffgrgsrlhikrtvaapsvfifpp<br>sdeqlksgtasvvcllnnfypreakvqwkvdnalqsgnsqesvteqdskdstysl<br>sstltlskadyekhkvyacevthqglsspvtksfnrgec | SEQ ID<br>NO: 122 |
| Heavy<br>chain<br>B | Evrlvesggglvkpggslrlscsasgfdfdnawmtwvrqppgkglewv<br>gritgpgegwsvdyaesvkgrftisrdntkntlylemnnvrtedtgyyfcar<br>tgkyydfwsgyppgeeyfqdwgqgtlvivssdkthtqmlqesgpglv<br>kpsetlsltcsvsgasisdsywswirrspgkglewigyvhksgdtnyspsl<br>ksrvnlsldtsknqvslslvaataadsgkyycartlhgrriygivafnewfty<br>fymdvwgngtqvtvssdkthtastkgpsvfplapsskstsggtaalgclvk<br>dyfpepvtvswnsgaltsgvhtfpavlqssglyslssvvtvpssslgtqtyic<br>nvnhkpsntkvdkkvepkscdkthtcppcpapellggpsvflfppkpkd<br>tlmisrtpevtcvvvdvshedpevkfnwyvdgvevhnaktkpreeqyns<br>tyrvvsvltvlhqdwlngkeykckvsnkalpapiektiskakgqprepqv<br>ytlppcrdeltknqvslwclvkgfypsdiavewesngqpennykttppvl<br>dsdgsfflyskltvdksrwqqgnvfscsvmhealhnhytqkslslspg | SEQ ID<br>NO: 123 |

TABLE 2-continued

Heavy and light chain sequences of binding proteins. CDR sequences are bolded and italicized.

| | | |
|---|---|---|
| Light chain B | tsdisvapgetariscgekslgsravqwyqhragqapsliiynnqdrpsgiperfsgs chainpdspfgttatltitsveagdeadyychiwdsrvptkwvfgggttltvldkthtaselt qdpavsvalkqtvtitcrgdslrshyaswyqkkpgqapvllfygknnrpsgipdrf sgsasgnrasltitgaqaedeadyycssrdksgsrlsvfgggtkltvldkthtrtvaap svfifppsdeqlksgtasvvcllnnfypreakvqwkvdnalqsgnsqesvteqds kdstyslsstltlskadyekhkvyacevthqglsspvtksfnrgec | SEQ ID NO: 124 |

Binding Protein 16 Nucleotide Sequences

| | | |
|---|---|---|
| Heavy chain A | agagcccacctggtgcagtctggcaccgccatgaagaaaccaggcgcctctgtgc ggtgtcctgtcagacaagcggctacaccttcaccgcccacatcctgttctggttccg gcaggccctggcagaggactggaatgggtgggatggatcaagcccagtatggc gccgtgaacttcggcggaggcttccgggatagagtgaccctgacccgggacgtgta ccgcgagatcgcctacatggacatccgggcctgaagcccgatgaccgccgtg tactactgcgccagagacagaagctacgcgacagcagctgggctctggatgcttg gggccagggcacaaccgtggtggtgtctgccgcctctacaaagggccccagcgtg ttccctctggccccctagcagcaagagcacatctggcggaacagccgccctgggctg cctcgtgaaggactactttcccgagcccgtgaccgtgtcctggaattctggcgccctg accagcggcgtgcacaccttttccagctgtgctgcagtccagcggcctgtacagcctg agcagcgtcgtgacagtgcccagcagctctgggcacccagacctacatctgcaa cgtgaaccacaagcccagcaacaccaaggtggacaagaaggtggaacccaagag ctgcgacaagacccacacctgtcccccttgtcctgccccgaactgctgggaggcc cttccgtgttcctgttccccccaaagcccaaggacaccctgatgatcagccggaccc ccgaagtgacctgcgtggtggtggatgtgtcccacgaggaccctgaagtgaagttca attggtacgtggacggcgtggaagtgcacaacgccaagaccaagccaagagagg aacagtacaacagcacctaccgggtggtgtccgtgctgaccgtgctgcaccaggac tggctgaacggcaaagagtacaagtgcaaggtgtccaacaaggccctgcctgcccc catcgagaaaaccatcagcaaggccaagggccagccccgcgaacccagtgtg cacactgcccccaagcagggacgagctgaccaagaaccaggtgtccctgagctgt gccgtgaaaggcttctaccccctccgatatcgccgtggaatgggagagcaacggcca gcccgagaacaactacaagaccaccccccctgtgctggacagcgacggctcattct tcctggtgtccaagctgacagtggacaagtcccggtggcagcagggcaacgtgttc agctgctccgtgatgcacgaggccctgcacaaccactacacccagaagtccctgag cctgagccccggcaag | SEQ ID NO: 125 |
| Light chain A | tacatccacgtgacccagagccccagcagcctgtccgtgtccatcggcgac agagtgaccatcaactgccagacctctcagggcgtgggcagcgacctgcac tggtatcagcacaagcctggcagagccccaagctgctgatccaccacaca agcagcgtggaagatggcgtgcccagcagattttccggcagcggcttccac accagcttcaacctgaccatcagcgatctgcaggccgacgacattgccacct actattgtcaggtgctgcagttcttcggcagaggcagcagactgcacatcaag cgtacggtggccgctcccagcgtgttcatcttcccacctagcgacgagcagc tgaagtccggcacagcctctgtcgtgtgcctgctgaacaacttctacccccgc gaggccaaagtgcagtggaaggtggacaacgccctgcagagcggcaaca gccaggaaagcgtgaccgagcaggacagcaaggactccacctacagcctg agcagcaccctgacactgagcaaggccgactacgagaagcacaaggtgta cgcctgcgaagtgacccaccagggcctgtctagccccgtgaccaagagctt caaccggggcgagtgt | SEQ ID NO: 126 |
| Heavy chain B | gaggttagactggtggagtcaggaggggggcttgtgaagcccggtgggtctctccg cctgagctgactgcctccggctttgatttcgataacgcctggatgacctgggtcaggc agcctccaggtaagggactggagtgggtgggaagaatcacaggtccaggcgagg gctggtccgtggactacgcggaatctgttaaagggcggtttacaatctcaagggaca ataccaagaataccttgtatttggagatgaacaacgtgagaactgaagcaccggat attacttctgtgccagaacaggcaaatactacgacttctggtccggctatcccctggc gaggaatattttcaagactgggtcagggaaccctggttatcgtgtcctcgacaaaa cccatacccagatgcagctgcaggagagcggccctggactcgtgaagcccagcga gaccctgagcctgacatgcagcgtgagcggcgccagcatcagcgacagctactgg agctggatcaggaggagccctggcaagggcctggagtggatcggctacgtgcaca agagcggcgacaccaactacagcccctcctgaagtccagggtgaacctgtccctg gacaccagcaagaaccaggtgagcctgtccctggtggctgccacagctgctgaca gcggcaagtactactgtgccaggaccctgcacggcaggaggatctacggcatcgtg gccttcaacgagtggttcacctacttctacatggacgtgtggggcaacggcacccag gtgaccgtgagctccgataagacccacacccgcttccaccaaggccccatcggtcttc cccctggcaccctcctccaagagcacctctggggcacagcggccctgggctgcct ggtcaaggactacttccccgaaccggtgacggtgtcgtggaactcaggcgccctga ccagcggcgtgcacaccttcccggctgtcctacagtcctcaggactctactccctcag cagcgtggtgaccgtgccctccagcagcttgggcacccagacctacatctgcaacg tgaatcacaagcccagcaacaccaaggtggacaagaaagttgagcccaaatcttgt gacaaaactcacacatgcccaccgtgcccagcacctgaactcctggggggaccgtc agtcttcctcttccccccaaaacccaaggacaccctcatgatctcccggacccctgag gtcacatgcgtggtggtggacgtgagccacgaagaccctgaggtcaagttcaactg gtatgttgacggcgtggaggtgcataatgccaagacaaagccgcgggaggagcag tacaacagcacgtaccgtgtggtcagcgtcctcaccgtcctgcaccaggactggctg aatggcaaggagtacaagtgcaaggtctccaacaaagccctcccagccccatcga gaaaccatctccaaagccaaagggcagccccgagaaccacaggtgtacaccctg cccccatgcccggatgagctgaccaagaatcaagtcagcctgtggtgcctggtaaa | SEQ ID NO: 127 |

TABLE 2-continued

Heavy and light chain sequences of binding proteins. CDR sequences are bolded and italicized.

| | | |
|---|---|---|
| | aggcttctatcccagcgacatcgccgtggagtgggagagcaatgggcagccggag<br>aacaactacaagaccacgcctcccgtgctggactccgacggctccttcttcctctact<br>caaaactcaccgtggacaagagcaggtggcagcaggggaacgtcttctcatgctcc<br>gtgatgcatgaggctctgcacaaccactacacgcagaagagcctctccctgtctccg<br>ggt | |
| Light<br>chain<br>B | ttccgacatcagcgtggcccccggagagacagccaggatctcctgcggcga<br>agaagagcctgggaagcagggctgtgcagtggtaccaacacagggccgga<br>caggctcccagcctgatcatctacaacaaccaggacaggcccagcggcatc<br>cctgagaggttcagcggaagccccgacagccccttcggaaccacagccac<br>cctgaccatcacaagcgtggaagccggcgacgaggccgactactactgcc<br>acatctgggacagcagggtgcccaccaagtgggtgtttggcggcggcacca<br>ccctgaccgtgctggacaaacccataccgcatccgaactgactcaggacc<br>ctgccgtctctgtggcactgaagcagactgtgactattacttgccgaggcgac<br>tcactgcggagccactacgcttcctggtatcagaagaaacccggccaggca<br>cctgtgctgctgttctacgaaagaacaataggccatctggcatccccgacc<br>gcttttctggcagtgcatcagggaaccgagccagtctgaccattaccggcgc<br>ccaggctgaggacgaagccgattactattgcagctcccgggataagagcgg<br>ctccagactgagcgtgttcggaggaggaactaaactgaccgtcctcgataag<br>acccataccgtacggtggccgctcccagcgtgttcatcttcccacctagcga<br>cgagcagctgaagtccggcacagcctctgtcgtgtgcctgctgaacaacttct<br>accccgcgaggccaaagtgcagtggaaggtggacaacgccctgcagag<br>cggcaacgccaggaaagcgtgaccgagcaggacagcaaggactccacc<br>tacagcctgagcagcaccctgacactgagcaaggccgactacgagaagca<br>aaggtgtacgcctgcgaagtgacccaccagggcctgtctagccccgtgac<br>caagagcttcaaccggggcgagtgt | SEQ ID<br>NO: 128 |

Binding Protein 17 Amino Acid Sequences

| | | |
|---|---|---|
| Heavy<br>chain<br>A | Rahlvqsgtamkkpgasvrvscqtsgytftahilfwfrqapgrglewvgwikpq<br>nygavnfgggfrdrvtltrdvyreiaymdirglkpddtavyycardrsygdsswal<br>dawgqggttvvvsaastkgpsvflplapssskstsggtaalgclvkdyfpepvtvswn<br>sgaltsgvhtfpavlqssglyslssvvtvpssslgtqtyicnvnhkpsntkvdkkve<br>pkscdkthtcppcpapellggpsvflfppkpkdtlmisrtpevtcvvvdvshedp<br>evkfnwyvdgvevhnaktkpreeqynstyrvvsvltvlhqdwlngkeykckvs<br>nkalpapiektiskakgqprepqvctlppsrdeltknqvslscavkgfypsdiave<br>wesngqpennykttppvldsdgsfflvskltvdksrwqqgnvfscsvmhealhn<br>hytqkslslspg | SEQ ID<br>NO: 129 |
| Light<br>chain<br>A | yihvtqspsslsvsigdrvtincqtsqgvgsdlhwyqhkpgrapkllihhtssved<br>gvpsrfsgsgsfhtsfnltisdlqaddiatyycqvlqffgrgsrlhikrtvaapsvfifpp<br>sdeqlksgtasvvcllnnfypreakvqwkvdnalqsgnsqesvteqdskdstysl<br>sstltlskadyekhkvyacevthqglsspvtksfnrgec | SEQ ID<br>NO: 130 |
| Heavy<br>chain<br>B | qvhltqsgpevrkpgtsykyscakapgntlktydlhwvrsvpgqglqwm<br>gwishegdkkviverfkakvtidwdrstntaylqlsgltsgdtavyycakg<br>skhrlrdyalydddgalnwavdvdylsnlefwgqgtavtvssdkthtqm<br>qlqesgpglykpsetlsltcsvsgasisdsywswirrspgkglewigyvhk<br>sgdtnyspslksrvnlsldtsknqvslslvaataadsgkyycartlhgrriygi<br>vafnewftyfymdvwgngtqvtvssdkthtastkgpsvflpapssskstsg<br>gtaalgclvkdyfpepvtvswnsgaltsgvhtfpavlqssglyslssvvtvp<br>ssslgtqtyicnynhkpsntkvdkkvepkscdkthtcppcpapellggps<br>vflfppkpkdtlmisrtpevtcvvvdvshedpevkfnwyvdgvevhna<br>ktkpreeqynstyrvvsvltvlhqdwlngkeykckvsnkalpapiektisk<br>akgqprepqvytlppcrdeltknqvslwclvkgfypsdiavewesngqp<br>ennykttppvldsdgsfflyskltvdksrwqqgnyfscsvmhealhnhyt<br>qkslslspg | SEQ ID<br>NO: 131 |
| Light<br>chain<br>B | tsdisvapgetariscgekslgsravqwyqhragqapsliiynnqdrpsgiperfsgs<br>npdspfgttatltitsveagdeadyychiwdsrvptkwfvgggttltvldkthtdfvlt<br>qsphslsvtpgesasiscksshslihgdrnnylawyvqkpgrspqlliylassrasg<br>vpdrfsgsgsdkdftlkisrvetedvgtyycmqgrespwtfgqgtkvdikdkthtr<br>tvaapsvfifppsdeqlksgtasvvcllnnfypreakvqwkvdnalqsgnsqesv<br>teqdskdstylssstltlskadyekhkvyacevthqglsspvtksfnrgec | SEQ ID<br>NO: 132 |

Binding Protein 17 Nucleotide Sequences

| | | |
|---|---|---|
| Heavy<br>chain<br>A | agagcccacctggtgcagtctggcaccgccatgaagaaaccaggcgcctctgtgc<br>gggtgtcctgtcagacaagcggctacaccttcaccgcccacatcctgttctggttccg<br>gcaggcccctggcagaggactggaatgggtgggatggatcaagcccagtatggc<br>gccgtgaacttcggcggaggcttccgggatagagtgacccctgacccgggacgtgta<br>ccgcgagatcgcctacatgacatccgggggcctgaagcccgatgactacgccgtg<br>tactactgcgccagagacagaagctacggcgacagcagctgggctctggatgcttg<br>gggccagggcacaaccgtggtggtgtctgccgcctctacaaaggggcccagcgtg<br>ttccctctggccccctagcagcaagagcacatctggcggaacagccgccctgggctg<br>cctcgtgaaggactactttcccgagcccgtgaccgtgtcctggaattctggcgccctg<br>accagcggcgtgcacaccttttccagctgtgctgcagtccagcggcctgtacagcctg | SEQ ID<br>NO: 133 |

TABLE 2-continued

Heavy and light chain sequences of binding proteins. CDR sequences are bolded and italicized.

| | | |
|---|---|---|
| | agcagcgtcgtgacagtgcccagcagctctctgggcacccagacctacatctgcaa cgtgaaccacaagcccagcaacaccaaggtggacaagaaggtggaacccaagag ctgcgacaagacccacacctgtccccttgtcctgccccgaactgctggaggcc cttccgtgttcctgaccccaaagcccaaggacaccctgatgatcagccggaccc ccgaagtgacctgcgtggtggtggatgtgtcccacgaggaccctgaagtgaagttca attggtacgtggacggcgtggaagtgcacaacgccaagaccaagccaagagagg aacagtacaacagcacctaccgggtggtgtccgtgctgaccgtgctgcaccaggac tggctgaacggcaaagagtacaagtgcaaggtgtccaacaagccctgcctgcccc catcgagaaaaccatcagcaaggccaagggccagccccgcgaacccaggtgtg cacactgccccaagcagggacgagctgaccaagaaccaggtgtccctgagctgt gccgtgaaaggcttctaccctcgatatcgccgtgaatgggagagcaacggcca gcccgagaacaactacaagaccaccccccctgtgctggacagcgacggctcattct tcctggtgtccaagctgacagtggacaagtcccgtggcagcagggcaacgtgttc agctgctccgtgatgcacgaggccctgcacaaccactacacccagaagtccctgag cctgagccccggcaag | |
| Light chain A | ttacatccacgtgacccagagccccagcagcctgtccgtgtccatcggcgac agagtgaccatcaactgccagacctctcagggcgtggacgactgcac tggtatcagcacaagcctggcagagccccaagctgctgatccaccacaca agcagcgtggaagatggcgtgcccagcagattttccggcagcggcttccac accagcttcaacctgaccatcagcgatctgcaggccgacgacattgccacct actattgtcaggtgctgcagttcttcggcagaggcagcagactgcacatcaag cgtacggtggccgctcccagcgtgttcatcttcccacctagcgacgagcagc tgaagtccggcacagcctctgtcgtgtgcctgctgaacaacttctacccccgc gaggccaaagtgcagtggaaggtggacaacgccctgcagagcggcaaca gccaggaaagcgtgaccgagcaggacagcaaggactccacctacagcctg agcagccctgacactgagcaaggccgactacgagaagcacaaggtgta cgcctgcgaagtgacccaccagggcctgtctagccccgtgaccaagagctt caaccggggcgagtgt | SEQ ID NO: 134 |
| Heavy chain B | caggtgcacctgacacagagcggaccgaagtgcggaagcctggcacctctgtga aggtgtcctgcaaggcccctggcaacaccctgaaaacctacgacctgcactgggtg cgcagcgtgccaggacagggactgcagtggatgggctggatcagccacgagggc gacaagaaagtgatcgtggaacggttcaaggccaaagtgaccatcgactgggaca gaagcaccaacaccgcctacctgcagctgagcggcctgacctctggcgataccgc cgtgtactactgcgccaagggcagcaagaccggctgagagactacgccctgtac gacgatgacggcgccctgaactgggccgtggatgtggactacctgagcaacctgg aattctggggccagggcacagccgtgaccgtgtcatctgacaaaacccatacccag atgcagctgcaggagagcggccctggactcgtgaagcccagcgagaccctgagc ctgacatgcagcgtgagcggcgccagcatcagcgacagctactggagctggatca ggaggagccctggcaagggcctggagtggatcggctacgtgcacaagagcggcg acaccaactacagcccctccctgaagtccagggtgaacctgtccctggacaccagc aagaaccaggtgagcctgtccctggtggctgccacagctgctgacagcggcaagta ctactgtgccaggaccctgcacgcaggaggatctacggcatcgtggccttcaacg agtggttcacctacttctacatggacgtgtggggcaacggcacccaggtgaccgtga gctccgataagacccacaccgcttccaccaagggcccatcggtcttccccctggcac cctcctccaagagcacctctgggggcacagcggccctgggctgcctggtcaagga ctacttccccgaaccggtgacggtgtcgtggaactcaggcgccctgaccagcggcg tgcacaccttcccggctgtcctacagtcctcaggactctactccctcagcagcgtggt gaccgtgccctccagcagcttgggcacccagacctacatctgcaacgtgaatcaca agcccagcaacaccaaggtggacaagaaagttgagcccaaatcttgtgacaaaact cacacatgcccaccgtgcccagcacctgaactcctgggggaccgtcagtcttcctc ttccccccaaaacccaaggacaccctcatgatctcccggacccctgaggtcacatgc gtggtggtggacgtgagccacgaagaccctgaggtcaagttcaactggtatgttgac ggcgtggaggtgcataatgccaagacaaagccgcggggaggagcagtacaacagc acgtaccgtgtggtcagcgtcctcaccgtcctgcaccaggactggctgaatggcaag gagtacaagtgcaaggtctccaacaaagcccctcccagccccatcgagaaaaccat ctccaaagccaaagggcagccccgagaaccacaggtgtacaccctgcccccatgc cgggatgagctgaccaagaatcaagtcagcctgtggtgcctggtaaaaggcttctat cccagcgacatcgccgtggagtgggagcaatgggcagccggagaacaactac aagaccacgcctcccgtgctggactccgacggctccttcttcctctactcaaaactca ccgtggacaagagcaggtggcagcaggggaacgtcttctcatgctccgtgatgcat gaggctctgcacaaccactacacgcagaagagcctctccctgtctccgggt | SEQ ID NO: 135 |
| Light chain B | ttccgacatcagcgtggcccccggagagacagccaggatctcctgcggcga aagagcctgggaagcagggctgtgcagtggtaccaacacagggccgga caggctcccagcctgatcatctacaacaaccaggacaggcccagcggcatc cctgagaggttcagcggaagccccgacagccccttcggaaccacagccac cctgaccatcacaagcgtggaagccggcgacgaggccgactactactgcc acatctgggacagcagggtgcccaccaagtgggtgtttggcggcggcacca ccctgaccgtgctggacaaaccataccgacttcgtgctgacccagagccc tcacagcctgagcgtgacacctggcgagagcgccagcatcagctgcaaga gcagccactccctgatccacgcgaccggaacaactacctggcttggtacgt gcagaagcccggcagatcccccagctgctgatctacctggccagcagca gagccagcggcgtgcccgatagattttctggcagcggcagcgacaaggact tcaccctgaagatcagccgggtggaaaccgaggacgtgggcacctactact gtatgcagggcagagagagcccctggacattggccagggcaccaaggtg | SEQ ID NO: 136 |

TABLE 2-continued

Heavy and light chain sequences of binding proteins. CDR sequences are bolded and italicized.

```
gacatcaaggataagacccataccgtacggtggccgctcccagcgtgttca
tcttcccacctagcgacgagcagctgaagtccggcacagcctctgtcgtgtg
cctgctgaacaacttctaccccgcgaggccaaagtgcagtggaaggtgga
caacgccctgcagagcggcaacagccaggaaagcgtgaccgagcaggac
agcaaggactccacctacagcctgagcagcaccctgacactgagcaaggc
cgactacgagaagcacaaggtgtacgcctgcgaagtgacccaccagggcc
tgtctagcccgtgaccaagagcttcaaccggggcgagtgt
```

Binding Protein 18 Amino Acid Sequences

| | | |
|---|---|---|
| Heavy chain A | ahlvqsgtamkkpgasvrvscqtsgytftahilfwfrqapgrglewvgwikpq nygavnfgggfrdrvtltrdvyreiaymdirglkpddtavyycardrsygdsswal dawgqgttvvvsaastkgpsvfplapssкstsggtaalgclvkdyfpepvtvswn sgaltsgvhtfpavlqssglyslssvvtvpssslgtqtyicnvnhkpsntkvdkkve pkscdkthtcppcpapellggpsvflfppkpkdtlmisrtpevtcvvvdvshedp evkfnwyvdgvevhnaktkpreeqynstyrvvsvltvlhqdwlngkeykckvs nkalpapiektiskakgqprepqvctlppsrdeltknqvslscavkgfypsdiave wesngqpennykttppvldsdgsffflvskltvdksrwqqgnvfscsvmhealh nhytqkslslspg | SEQ ID NO: 137 |
| Light chain A | yihvtqspsslsvsigdrvtincqtsqgvgsdlhwyqhkpgrapkllihhtssved ngvpsrfsgsgfhtsfnltisdlqaddiatyycqvlqffgrgsrlhikrtvaapsvfifp psdeqlksgtasvvcllnnfypreakvqwkvdnalqsgnsqesvteqdskdstys lsstltlskadyekhkvyacevthqglsspvtksfnrgec | SEQ ID NO: 138 |
| Heavy chain B | yqmqlqesgpglvkpsetlsltcsvsgasisdsywswirrspgkglewigy nvhksgdtnyspslksrvnlsldtsknqvslslvaataadsgkyycartlhgrr iygivafnewftyfymdvwgngtqvtvssdkthtevrlvesgglvkpg gsltlscsasgfdfdnawmtwvrqppgkglewvgritgpgegwsvdya esvkgrftisrdntknlylemnnvrtedtgyyfcartgkyydfwsgyppg eeyfqdwgqgtlvivssdkthtastkgpsvfplapssкstsggtaalgclvk dyfpepvtvswnsgaltsgvhtfpavlqssglyslssvvtvpssslgtqtyic nvnhkpsntkvdkkvepkscdkthtcppcpapellggpsvflfppkpkd tlmisrtpevtcvvvdvshedpevkfnwyvdgvevhnaktkpreeqyn styrvvsvltvlhqdwlngkeykckvsnkalpapiektiskakgqprepq vytlppcrdeltknqvslwclvkgfypsdiavewesngqpennykttpp vldsdgsfflyskltvdksrwqqgnvfscsvmhealhnhytqkslslspg | SEQ ID NO: 139 |
| Light chain B | aseltqdpavsvalkqtvtitcrgdslrshyaswyqkkpgqapvllfygknnrpsg nipdrfsgsasgnrasltitgaqaedeadyycssrdksgsrlsvfgggtkitvldkthts disvapgetariscgekslgsravqwyqhragqapsliiynnqdrpsgiperfsgs pdspfgttatltitsveagdeadyychiwdsrvptkwvfgggttltvldkthtrtvaa psvfifppsdeqlksgtasvvcllnnfypreakvqwkvdnalqsgnsqesvteqd skdstyslsstltlskadyekhkvyacevthqglsspvtksfnrgec | SEQ ID NO: 140 |

Binding Protein 18 Nucleotide Sequences

| | | |
|---|---|---|
| Heavy chain A | agagcccacctggtgcagtctggcaccgccatgaagaaaccaggcgcctctgtgc ggtgtcctgtcagacaagcggctacaccttcaccgcccacatcctgttctggttccg gcaggcccctggcagaggactggaatgggtgggatggatcaagccccagtatggc gccgtgaacttcggcggaggcttccgggatagagtgaccctgaccctgggacgtgta ccgcgagatcgcctacatggacatccggggcctgaagcccgatgacaccgccgtg tactactgcgccagagacagaagctacggcgacagcagctgggctctggatgcttg gggccagggcacaaccgtggtggtgtctgccgcctctacaaagggccccagcgtg ttccctctggccctagcagcaagagcacatctggcggaacagccgccctgggctg cctcgtgaaggactactttcccgagcccgtgaccgtgtcctggaattctggcgccctg accagcggcgtgcacacctttccagctgtgctgcagtccagcggcctgtacagcctg agcagcgtcgtgacagtgcccagcagctctctgggcacccagacctacatctgcaa cgtgaaccacaagcccagcaacaccaaggtggacaagaaggtggaacccaagag ctgcgacaagacccacacctgtccccttgtcctgccccgaactgctgggaggcc cttccgtgttcctgttccccccaaagcccaaggacaccctgatgatcagccggaccc ccgaagtgacctgcgtggtggtggatgtgtcccacgaggaccctgaagtgaagttca attggtacgtggacggcgtggaagtgcacaacgccaagaccaagccaagagagg aacagtacaacagcacctaccgggtggtgtccgtgctgaccgtgctgcaccaggac tggctgaacggcaaagagtacaagtgcaaggtgtccaacaaggccctgcctgcccc catcgagaaaaccatcagcaaggccaagggccagccccgcgaacccaggtgtg cacactgccccaagcagggacgagctgaccaagaaccaggtgtccctgagctgt gccgtgaaaggcttctacccctccgatatcgccgtggaatgggaagcaacggcca gcccgagaacaactacaagaccaccccccctgtgctggacagcgacggctcattct tcctggtgtccaagctgacagtggacaagtcccggtggcagcagggcaacgtgttc agctgctccgtgatgcacgaggccctgcacaaccactacacccagaagtccctgag cctgagcccggcaag | SEQ ID NO: 141 |
| Light chain A | ttacatccacgtgacccagagcccagcagcctgtccgtgtccatcggcgac agagtgaccatcaactgccagacctctcagggcgtgggcagcgacctgcac tggtatcagcacaagcctggcagagcccccaagctgctgatccaccacaca agcagcgtggaagatggcgtgcccagcagattttccggcagcggcttccac | SEQ ID NO: 142 |

TABLE 2-continued

Heavy and light chain sequences of binding proteins. CDR sequences are bolded and italicized.

| | | |
|---|---|---|
| | accagcttcaacctgaccatcagcgatctgcaggccgacgacattgccacct actattgtcaggtgctgcagttcttcggcagaggcagcagactgcacatcaag cgtacggtggccgctcccagcgtgttcatcttcccacctagcgacgagcagc tgaagtccggcacagcctctgtcgtgtgcctgctgaacaacttctaccccgc gaggccaaagtgcagtggaaggtggacaacgccctgcagagcggcaaca gccaggaaagcgtgaccgagcaggacagcaaggactccacctacagcctg agcagcaccctgacactgagcaaggccgactacgagaagcacaaggtgta cgcctgcgaagtgacccaccagggcctgtctagccccgtgaccaagagctt caaccggggcgagtgt | |
| Heavy chain B | cagatgcagctgcaggagagcggccctggactcgtgaagcccagcgagaccctg agcctgacatgcagcgtgagcggcgccagcatcagcgacagctactggagctgga tcaggaggagccctggcaagggcctggagtggatcggctacgtgcacaagagcg gcgacaccaactacagccctccctgaagtccagggtgaacctgtccctggacacc agcaagaaccaggtgagcctgtccctggtggctgccacagctgctgacagcggca agtactactgtgccaggaccctgcacggcaggaggatctacggcatcgtggccttca acgagtggttcacctacttctacatggacgtgtggggcaacggcacccaggtgacc gtgagctccgacaaaacccataccgaggttagactggtggagtcaggaggggggc ttgtgaagcccggtgggtctctccgcctgagctgttctgcctccggctttgatttcgata acgcctggatgacctgggtcaggcagcctccaggtaagggactggagtgggtggg aagaatcacaggtccaggcgagggctggtccgtgactacgcggaatctgttaaag ggcggtttacaatctcaagggacaataccaagaatacctttgtataggagatgaacaa cgtgaactgaagacaccggatattacttctgtgccagaacaggcaaatactacga cttctggtccggctatcccctggcgaggaatattacaagactgggtcagggaacc cttgttatcgtgtcctccgataagacccacaccgcttccaccaagggcccatcggtctt cccctggcaccctcctccaagagcacctctggggcacagcggccctgggctgc ctggtcaaggactacttccccgaaccggtgacggtgtcgtggaactcaggcgccct gaccagcggcgtgcacaccaccccggctgtcctacagtcctcaggactctactccctc agcagcgtggtgaccgtgccctccagcagcttgggcacccagacctacatctgcaa cgtgaatcacaagcccagcaacaccaaggtggacaagaaagttgagcccaaatat gtgacaaaactcacacatgcccacctgcccagcacctgaactcctgggggacc gtcagtatcctcttcccccaaaacccaaggacaccctcatgatctcccggacccct gaggtcacatgcgtggtggtggacgtgagccacgaagaccctgaggtcaagttcaa ctggtatgagacggcgtggaggtgcataatgccaagacaaagccgcgggaggag cagtacaacagcacgtaccgtgtggtcagcgtcctcaccgtcctgcaccaggactg gctgaatggcaaggagtacaagtgcaaggtctccaacaaagcccccagcccca tcgagaaaaccatctccaaagccaaagggcagccccgagaaccacaggtgtacac cctgcccccatgccgggatgagctgaccaagaatcaagtcagcctgtggtgcctggt aaaaggcttctatcccagcgacatcgccgtggagtgggagcaatgggcagccg gagaacaactacaagaccacgcctcccgtgctggactccgacggctccttcttcctct actcaaaactcaccgtggacaagagcaggtggcagcaggggaacgtcttctcatgc tccgtgatgcatgaggctctgcacaaccactacacgcagaagagcctctccctgtctc cgggt | SEQ ID NO: 143 |
| Light chain B | gcatccgaactgactcaggaccctgccgtctctgtggcactgaagcagactg tgactattacttgccgaggcgactcactgcggagccactacgcttcctggtatc agaagaaacccggccaggcacctgtgctgctgttctacggaaagaacaata ggccatctggcatcccccgaccgcttttctggcagtgcatcagggaaccgagc cagtctgaccattaccggcgcccaggctgaggacgaagccgattactattgc agctcccgggataagagcggctccagactgagcgtgttcggaggaggaact aaaactgaccgtcctcgacaaaacccatacctccgacatcagcgtggccccc ggagagacagcaggatctcctgcggcgagaagagcctgggaagcaggg ctgtgcagtggtaccaacacagggccggacaggctcccagcctgatcatcta caacaaccaggacaggcccagcggcatccctgagaggttcagcggaagcc ccgacagccccttcggaaccacagccaccctgaccatcacaagcgtggaa gccggcgacgaggccgactactactgccacatctgggacagcagggtgcc caccaagtgggtgtttggcggcggcaccaccctgaccgtgctggataagac ccataccccgtacggtggccgctcccagcgtgttcatcttcccacctagcgacg agcagctgaagtccggcacagcctctgtcgtgtgcctgctgaacaacttctac ccccgcgaggccaaagtgcagtggaaggtggacaacgccctgcagagcg gcaacagccaggaaagcgtgaccgagcaggacagcaaggactccaccta cagcctgagcagcaccctgacactgagcaaggccgactacgagaagcaca aggtgtacgcctgcgaagtgacccaccagggcctgtctagccccgtgacca agagcttcaaccggggcgagtgt | SEQ ID NO: 144 |

Binding Protein 19 Amino Acid Sequences

| | | |
|---|---|---|
| Heavy chain A | evrlvesgggglvkpggslrlscsasgfdfdnawmtwvrqppgkglewvgritgp gegwsvdyaesvkgrftisrdntkntlylemnnvrtedtgyyfcartgkyydfws gyppgeeyfqdwgqgtlvivss<u>astkgpsvfplapsskstsggtaalgclvkdyfp epvtvswnsgaltsgvhtfpavlqssglyslssvvtvpssslgtqtyicnvnhkpsn tkvdkkvepkscdkthtcppcpapellgqpsvflfppkpkdtlmisrtpevtcvv vdvshedpevkfnwyvdgvevhnaktkpreegynstyrvvsvltvlhqdwlnq keykckvsnkalpapiektiskakgqprepqvctlppsrdeltknqvslscavkgf vpsdiavewesngqpennykttppvldsdgsfflvskltvdksrwqqgnvfscs vmhealhnhytqkslslspq</u> | SEQ ID NO: 145 |

TABLE 2-continued

Heavy and light chain sequences of binding proteins. CDR sequences are bolded and italicized.

| | | |
|---|---|---|
| Light chain A | aseltqdpavsvalkqtvtitcrgdslrshyaswyqkkpgqapvllfygknnrpsg nipdrfsgsasgnrasltitgaqaedeadyycssrdksgsrlsvfgggtkltvlsqpka apsvtlfppsseelqankatlvclisdfypgavtvawkadsspvkagvettlpskqs nnkyaassylsltpeqwkshrsyscqvthegstvektvaptecs | SEQ ID NO: 146 |
| Heavy chain B | yqmqlqesgpglvkpsetlsltcsvsgasisdsywswirrspgkglewigy nvhksgdtnyspslksrvnlsldtsknqvslslvaataadsgkyycartlhgrr iygivafnewftyfymdvwgngtqvtvssdkthtQvhltqsgpevrkpg tsvkvsckapgntlktydlhwvrsvpgqglqwmgwishegdkkviver fkakvtidwdrstntaylqlsgltsgdtavyycakgskhrlrdyalydddga lnwavdvdylsnlefwgqgtavtvssdkthtastkgpsvfplapsskstsg gtaalgclvkdyfpepvtvswnsgaltsgvhtfpavlqssglyslssvvtvp ssslgtqtyicnvnhkpsntkvdkkvepkscdkthtcppcpapellggps vflfppkpkdtlmisrtpevtcvvvdvshedpevkfnwyvdgvevhna ktkpreeqynstyrvvsvltvlhqdwlngkeykckvsnkalpapiektisk akgqprepqvytlppcrdeltknqvslwclvkgfypsdiavewesngqp ennykttppvldsdgsfflyskltvdksrwqqgnvfscsvmhealhnhyt qkslslspg | SEQ ID NO: 147 |
| Light chain B | dfvltqsphslsvtpgesasisckshshslihgdrnnylawyvqkpgrspqlliylass rasgvpdrfsgsgsdkdftlkisrvetedvgtyycmqgrespwtfgqgtkvdikd kthtsdisvapgetariscgekslgsravqwyqhragqapsliiynnqdrpsgiper fsgspdspfgttatltitsveagdeadyychiwdsrvptkwvfgggtltvldkthtrt vaapsvfifppsdeqlksgtasvvcllnnfypreakvqwkvdnalqsgnsqesvt eqdskdstyslsstltlskadyekhkvyacevthqglsspvtksfnrgec | SEQ ID NO: 148 |

Binding Protein 19 Nucleotide Sequences

| | | |
|---|---|---|
| Heavy chain A | gaggttagactggtggagtcaggagggggcttgtgaagcccggtgggtctctccg cctgagctgactgcctccggctttgatttcgataacgcctggatgacctgggtcaggc agcctccaggtaagggactggagtgggtgggaagaatcacaggtccaggcgagg gctggtccgtggactacgcggaatctgttaaagggcggtttacaatctcaagggaca ataccaagaatacctttgtataggagatgaacaacgtgagaactgaagacaccggat attacttctgtgccagaacaggcaaatactacgacttctggtccggctatcccctggc gaggaatattacaagactgggtcagggaacccttgttatcgtgtcctccgcgtcga ccaagggcccagcgtgttccctctggccccagcagcaagagcacatctggcgga acagccgccctgggctgcctcgtgaaggactactaccgagcccgtgaccgtgtcc tggaattctggcgccctgaccagcggcgtgcacacctaccagctgtgctgcagtcc agcggcctgtacagcctgagcagcgtcgtgacagtgcccagcagctctctgggcac ccagacctacatctgcaacgtgaaccacaagcccagcaacaccaaggtggacaag aaggtggaacccaagagctgcgacaagacccacacctgtcccccttgtcctgcccc cgaactgctgggaggccttccgtgttcctgaccccccaaagcccaaggacaccct gatgatcagccggacccccgaagtgacctgcgtggtggtggatgtgtcccacgagg accctgaagtgaagttcaattggtacgtggacggcgtggaagtgcacaacgccaag accaagccaagagaggaacagtacaacagcacctaccgggtggtgtccgtgctga ccgtgctgcaccaggactggctgaacggcaaagagtacaagtgcaaggtgtccaa caagggcctgcctgcccccatcgagaaaaccatcagcaaggccaagggccagcc ccgcgaacccaggtgtgcacactgccccaagcagggacgagctgaccaagaa ccaggtgtccctgagctgtgccgtgaaaggcttctacccctccgatatcgccgtgga atgggagagcaacggccagcccgagaacaactacaagaccaccccccctgtgctg gacagcgacggctcattcttcctggtgtccaagctgacagtggacaagtcccggtgg cagcagggcaacgtgttcagctgctccgtgatgcacgaggccctgcacaaccacta cacccagaagtccctgagcctgagcccggcaag | SEQ ID NO: 149 |
| Light chain A | gcatccgaactgactcaggaccctgccgtctctgtggcactgaagcagactg tgactattacttgccgaggcgactcactgcggagccactacgcttcctggtatc agaagaaacccggccaggcacctgtgctgctgttctacgaaagaacaata ggccatctggcatcccgaccgcttttctggcagtgcatcagggaaccgagc cagtctgaccattaccggcgcccaggctgaggacgaagccgattactattgc agctcccgggataagagcggctccagactgagcgtgttcggagggaggaact aaactgaccgtcctcagtcagcccaaggctgccccctcggtcactctgttccc gccctcgagtgaggagcttcaagccaacaaggccacactggtgtgtctcata agtgacttctacccgggagccgtgacagtggcctggaaggcagatagcagc ccgtcaaggcgggagtggagaccaccacccctccaaacaaagcaacaa caagtacgcggccagcagctacctgagcctgacgcctgagcagtggaagtc ccacagaagctacagctgccaggtcacgcatgaagggagcaccgtggaga agacagtggcccctacagaatgttca | SEQ ID NO: 150 |
| Heavy chain B | cagatgcagctgcaggagagcggccctggactcgtgaagcccagcgagaccctg agcctgacatgcagcgtgagcggcgccagcatcagcgacagctactggagctgga tcaggaggagccctggcaagggcctggagtggatcggctacgtgcacaagagcg gcgacaccaactacagcccctccctgaagtccagggtgaacctgtccctggacacc agcaagaaccaggtgagcctgtccctggtggccacagcgctgacagcggca agtactactgtgccaggaccctgcacggcaggaggatctacggcatcgtggccttca acgagtggttcacctacttctacatggacgtgtggggcaacggcacccaggtgacc gtgagctccgacaaaacccatacccaggtgcacctgacacagagcggacccgaag tgcggaagcctggcacctctgtgaaggtgtcctgcaaggcccctggcaacaccctg | SEQ ID NO: 151 |

TABLE 2-continued

Heavy and light chain sequences of binding proteins. CDR sequences are bolded and italicized.

| | | |
|---|---|---|
| | aaaacctacgacctgcactgggtgcgcagcgtgccaggacagggactgcagtgga<br>tgggctggatcagccacgagggcgacaagaaagtgatcgtggaacggttcaaggc<br>caaagtgaccatcgactgggacagaagcaccaacaccgcctacctgcagctgagc<br>ggcctgacctctggcgataccgccgtgtactactgcgccaagggcagcaagcacc<br>ggctgagagactacgccctgtacgacgatgacggcgccctgaactgggccgtgga<br>tgtggactacctgagcaacctggaattctggggccagggcacagccgtgaccgtgt<br>catctgataagacccacaccgcttccaccaagggcccatcggtcttccccctggcac<br>cctcctccaagagcacctctgggggcacagcggccctgggctgcctggtcaagga<br>ctacttccccgaaccggtgacggtgtcgtggaactcaggcgccctgaccagcggcg<br>tgcacacctttccggctgtcctacagtcctcaggactctactccctcagcagcgtggt<br>gaccgtgccctccagcagcttgggcacccagacctacatctgcaacgtgaatcaca<br>agcccagcaacaccaaggtggacaagaaagttgagcccaaatcttgtgacaaaact<br>cacacatgcccaccgtgcccagcacctgaactcctggggggaccgtcagtcttcctc<br>ttccccccaaaacccaaggacaccctcatgatctcccggacccctgaggtcacatgc<br>gtggtggtggacgtgagccacgaagaccctgaggtcaagttcaactggtatgttgac<br>ggcgtggaggtgcataatgccaagacaaagccgcgggaggagcagtacaacagc<br>acgtaccgtgtggtcagcgtcctcaccgtcctgcaccaggactggctgaatggcaag<br>gagtacaagtgcaaggtctccaacaaagcccctcccagccccatcgagaaaaccat<br>ctccaaagccaaagggcagccccgagaaccacaggtgtacaccctgcccccatgc<br>cgggatgagctgaccaagaatcaagtcagcctgtggtgcctggtaaaaggcttctat<br>cccagcgacatcgccgtggagtgggagagcaatgggcagccggagaacaactac<br>aagaccacgcctcccgtgctggactccgacggctccttcttcctctactcaaaactca<br>ccgtggacaagagcaggtggcagcagggggaacgtcttctcatgctccgtgatgcat<br>gaggctctgcacaaccactacacgcagaagagcctctccctgtctccgggt | |
| Light chain B | gacttcgtgctgacccagagccctcacagcctgagcgtgacacctggcgag<br>agcgccagcatcagctgcaagagcagccactccctgatccacggcgaccg<br>gaacaactacctggcttggtacgtgcagaagcccggcagatcccccagct<br>gctgatctacctggccagcagcagagccagcggcgtgcccgatagattttct<br>ggcagcggcagcgacaaggacttcaccctgaagatcagccgggtggaaac<br>cgaggacgtgggcacctactactgtatgcagggcagagagagccccctgga<br>cctttggccagggcaccaaggtggacatcaaggacaaaacccatacctccg<br>acatcagcgtggcccccggagagacagccaggatctcctgcggcgagaag<br>agcctgggaagcagggctgtgcagtggtaccaacacagggccggacagg<br>ctcccagcctgatcatctacaacaaccaggacaggcccagcggcatccctg<br>agaggttcagcggaagccccgacagccccttcggaaccacagccaccctg<br>accatcacaagcgtggaagccggcgacgaggccgactactactgccacatc<br>tgggacagcagggtgcccaccaagtgggtgtaggcggcggcaccaccct<br>gaccgtgctggataagacccataccccgtacggtggccgctcccagcgtgttc<br>atcttcccacctagcgacgagcagctgaagtccggcacagcctctgtcgtgt<br>gcctgctgaacaacttctaccccgcgaggccaaagtgcagtggaaggtgg<br>acaacgcccgcagagcggcaacagccaggaaagcgtgaccgagcagga<br>cagcaaggactccacctacagcctgagcagcaccctgacactgagcaagg<br>ccgactacgagaagcacaaggtgtacgcctgcgaagtgacccaccagggc<br>ctgtctagccccgtgaccaagagcttcaaccggggcgagtgt | SEQ ID<br>NO: 152 |

Binding Protein 20 Amino Acid Sequences

| | | |
|---|---|---|
| Heavy chain A | Rahlvqsgtamkkpgasvrvscqtsgytftahilfwfrqapgrglewvgwikpq<br>nygavnfgggfrdrvtltrdvyreiaymdirglkpddtavyycardrsygdsswal<br>dawgqgttvvvsaastkgpsvfplapsskstsggtaalgclvkdyfpepvtvswn<br>sgaltsgvhtfpavlqssglyslssvvtvpssslgtqtyicnvnhkpsntkvdkkve<br>pkscdkthtcppcpapellggpsvflfppkpkdtlmisrtpevtcvvvdvshedp<br>evkfnwyvdgvevhnaktkpreeqynstyrvvsvltvlhqdwlngkeykckvs<br>nkalpapiektiskakgqprepqvctlppsrdeltknqvslscavkgfypsdiave<br>wesngqpennykttppvldsdgsfflvskltvdksrwqqgnvfscsvmhealhn<br>hytqkslslspg | SEQ ID<br>NO: 153 |
| Light chain A | tyihvtqspsslsvsigdrvtincqtsqgvgsdlhwyqhkpgrapkllihhtssved<br>gvpsrfsgsgfhtsfnltisdlqaddiatyycqvlqfgrgsrlhikrtvaapsvfifpp<br>sdeqlksgtasvvcllnnfypreakvqwkvdnalqsgnsqesvteqdskdstysl<br>sstltlskadyekhkvyacevthqglsspvtksfnrgec | SEQ ID<br>NO: 154 |
| Heavy chain B | yqmqlqesgpglvkpsetlsltcsvsgasisdsywswirrspgkglewigy<br>nvhksgdtnyspslksrvnlsldtsknqvslslvaataadsgkyycartlhgrr<br>iygivafnewftyfymdvwgngtqvtvssdkthtQvhltqsgpevrkpg<br>tsvkvsckapgntlktydlhwvrsvpgqglqwmgwishegdkkviver<br>fkakvtidwdrstntaylqlsgltsgdtavyycakgskhrlrdyalydddga<br>lnwavdvdylsnlefwgqgtavtvssdkthtastkgpsvfplapsskstsg<br>gtaalgclvkdyfpepvtvswnsgaltsgvhtfpavlqssglyslssvvtvp<br>ssslgtqtyicnvnhkpsntkvdkkvepkscdkthtcppcpapellggps<br>vflfppkpkdtlmisrtpevtcvvvdvshedpevkfnwyvdgvevhna<br>ktkpreeqynstyrvvsvltvlhqdwlngkeykckvsnkalpapiektisk<br>akgqprepqvytlppcrdeltknqvslwclvkgfypsdiavewesngqp<br>ennykttppvldsdgsfflyskltvdksrwqqgnvfscsvmhealhnhyt<br>qkslslspg | SEQ ID<br>NO: 155 |

TABLE 2-continued

Heavy and light chain sequences of binding proteins. CDR sequences are bolded and italicized.

| | | |
|---|---|---|
| Light chain B | dfvltqsphslsvtpgesasiscksshslihgdrnnylawyvqkpgrspqlliylass rasgvpdrfsgsgsdkdftlkisrvetedvgtyycmqgrespwtfgqgtkvdikd kthtsdisvapgetariscgekslgsravqwyqhragqapsliiynnqdrpsgiper fsgspdspfgttatltitsveagdeadyychiwdsrvptkwvfgggttltvldkthtrt vaapsvfifppsdeqlksgtasvvcllnnfypreakvqwkvdnalqsgnsqesvt eqdskdstyslsstltlskadyekhkvyacevthqglsspvtksfnrgec | SEQ ID NO: 156 |

Binding Protein 20 Nucleotide Sequences

| | | |
|---|---|---|
| Heavy chain A | agagcccacctggtgcagtctggcaccgccatgaagaaaccaggcgcctctgtgc gggtgtcctgtcagacaagcggctacaccttcaccgcccacatcctgttctggttccg gcaggcccctggcagaggactggaatgggtgggatggatcaagcccagtatggc gccgtgaacttcggcggaggcttccgggatagagtgaccctgacccgggacgtgta ccgcgagatcgcctacatggacatccgggggcctgaagcccgatgaaccgccgtg tactactgcgccagagacagaagctacgcgacagcagctgggctctggatgcttg gggccagggcacaaccgtggtggtgtctgccgcctctacaaagggccccagcgtg ttccctctggccccctagcagcaagagcacatctggcggaacagccgccctgggctg cctcgtgaaggactactttcccgagcccgtgaccgtgtcctggaattctggcgccctg accagcggcgtgcacacctttccagctgtgctgcagtccagcggcctgtacagcctg agcagcgtcgtgacagtgcccagcagctctctgggcacccagacctacatctgcaa cgtgaaccacaagcccagcaacaccaaggtggacaagaaggtggaacccaagag ctgcgacaagacccacacctgtcccccttgtcctgcccccgaactgctgggaggcc cttccgtgttcctgttccccccaaagcccaaggacaccctgatgatcagccggaccc ccgaagtgacctgcgtggtggtggatgtgtcccacgaggaccctgaagtgaagttc aattggtacgtggacggcgtggaagtgcacaacgccaagaccaagccaagagag gaacagtacaacagcacctaccgggtggtgtccgtgctgctgcaccagga ctggctgaacggcaaagagtacaagtgcaaggtgtccaacaaggccctgcctgcc cccatcgagaaaaccatcagcaaggccaagggccagccccgcgaaccccaggtg tgcacactgcccccaagcagggacgagctgaccaagaaccaggtgtccctgagct gtgccgtgaaaggcttctacccctccgatatcgccgtggaatgggagagcaacggc agcccgagaacaactacaagaccaccccctgtgctggacagcgacggctcatt cttcctggtgtccaagctgacagtggacaagtcccggtggcagcagggcaacgtgtt cagctgctccgtgatgcacgaggccctgcacaaccactacacccagaagtccctga gcctgagccccggcaag | SEQ ID NO: 157 |
| Light chain A | ttacatccacgtgacccagagccccagcagcctgtccgtgtccatcggcgac agagtgaccatcaactgccagacctctcagggcgtgggcagcgacctgcac tggtatcagcacaagcctggcagagccccaagctgctgatccaccacaca agcagcgtggaagatggcgtgcccagcagattttccggcagcgcttccac accagcttcaacctgaccatcagcgatctgcaggccgacgacattgccacct actattgtcaggtgctgcagttcttcggcagaggcagcagactgcacatcaag cgtacggtggccgctcccagcgtgttcatcttcccacctagcgacgagcagc tgaagtccggcacagcctctgtcgtgtgcctgctgaacaacttctaccccgc gaggccaaagtgcagtggaaggtggacaacgccctgcagagcggcaaca gccaggaaagcgtgaccgagcaggacagcaaggactccacctacagcctg agcagcaccctgacactgagcaaggccgactacgagaagcacaaggtgta cgcctgcgaagtgacccaccagggcctgtctagccccgtgaccaagagctt caaccggggcgagtgt | SEQ ID NO: 158 |
| Heavy chain B | cagatgcagctgcaggagagcggccctggactcgtgaagcccagcgagaccctg agcctgacatgcagcgtgagcggcgccagcatcagcgacagctactggagctgga tcaggaggagccctggcaagggcctggagtggatcggctacgtgcacaagagcg gcgacaccaactacagccccctccctgaagtccagggtgaacctgtccctggacacc agcaagaaccaggtgagcctgtccctggtggctgccacagctgctgacagcggca agtactactgtgccaggaccctgcacggcaggaggatctacggcatcgtggccttc aacgagtggttcacctacttctacatggacgtgtggggcaacgccaccaggtgac cgtgagctccgacaaaacccataccaggtgcacctgacacagagcggaccccgaa gtgcggaagcctggcacctctgtgaaggtgtcctgcaaggcccctggcaacacccct gaaaacctacgacctgcactgggtgcgcagcgtgccaggacagggactgcagtgg atgggctggatcagccacgagggcgacaagaaagtgatcgtgaacggttcaagg ccaaagtgaccatcgactgggacagaagcaccaacaccgcctacctgcagctgag cggcctgacctctgccgataccgccgtgtactactgcgccaagggcagcaagcac cggctgagagactacgccctgtacgacgatgacggcgccctgaactgggccgtgg atgtggactacctgagcaacctggaattctggggccagggcacagccgtgaccgtg tcatctgataagacccacaccgcttccaccaagggcccatcggtcttcccctggca cccctcctccaagagcacctctggggcacagcggccctgggctgcctggtcaagg actacttccccgaaccggtgacggtgtcgtggaactcaggcgccctgaccagcggc gtgcacaccttcccggctgtcctacagtcctcaggactctactcctcagcagcgtgg tgaccgtgccctccagcagcttgggcacccagacctacatctgcaacgtgaatcaca agcccagcaacaccaaggtggacaagaaagttgagcccaaatcttgtgacaaaact cacacatgcccaccgtgcccagcacctgaactcctggggggaccgtcagtcttcctc ttccccccaaaacccaaggacaccctcatgatctcccggacccctgaggtcacatgc gtggtggtggacgtgagccacgaagaccctgaggtcaagttcaactggtatgttgac ggcgtggaggtgcataatgccaagacaaagccgcgggaggagcagtacaacagc acgtaccgtgtggtcagcgtcctcaccgtcctgcaccaggactggctgaatggcaa ggagtacaagtgcaaggtctccaacaaagccctcccagccccatcgagaaaacc atctccaaagccaaagggcagccccgagaaccacaggtgtacaccctgcccccat | SEQ ID NO: 159 |

TABLE 2-continued

Heavy and light chain sequences of binding proteins. CDR sequences are bolded and italicized.

| | | |
|---|---|---|
| | gccgggatgagctgaccaagaatcaagtcagcctgtggtgcctggtaaaaggcttct<br>atcccagcgacatcgccgtggagtgggagagcaatgggcagccggagaacaact<br>acaagaccacgcctcccgtgctggactccgacggctccttcttcctctactcaaaact<br>caccgtggacaagagcaggtggcagcaggggaacgtcttctcatgctccgtgatgc<br>atgaggctctgcacaaccactacacgcagaagagcctctccctgtctccgggt | |
| Light<br>chain<br>B | gacttcgtgctgacccagagccctcacagcctgagcgtgacacctggcgag<br>agcgccagcatcagctgcaagagcagccactccctgatccacggcgaccg<br>gaacaactacctggcttggtacgtgcagaagcccggcagatcccccagct<br>gctgatctacctggccagcagcagagccagcggcgtgcccgatagattctct<br>ggcagcggcagcgacaaggacttcaccctgaagatcagccgggtggaaac<br>cgaggacgtgggcacctactactgtatgcagggcagagagcccctgga<br>cctttggccagggcaccaaggtggacatcaaggacaaaacccatacctccg<br>acatcagcgtgccccccggagagacagccaggatctcctgcggcgagaag<br>agcctgggaagcagggctgtgcagtggtaccaacacagggccggacagg<br>ctcccagcctgatcatctacaacaaccaggacaggcccagcggcatccctg<br>agaggttcagcggaagcccccgacagcccttcggaaccacagccaccctg<br>accatcacaagcgtggaagccggcgacgaggccgactactactgccacatc<br>tgggacagcagggtgcccaccaagtgggtgtttggcggcggcaccaccct<br>gaccgtgctggataagacccataccgtacggtggccgctcccagcgtgttc<br>atcttcccacctagcgacgagcagctgaagtccggcacagcctctgtcgtgt<br>gcctgctgaacaacttctacccccgcgaggccaaagtgcagtggaaggtgg<br>acaacgccctgcagagcggcaacagccaggaaagcgtgaccgagcagga<br>cagcaaggactccacctacagcctgagcagcaccctgacactgagcaagg<br>ccgactacgagaagcacaaggtgtacgcctgcgaagtgacccaccagggc<br>ctgtctagccccgtgaccaagagcttcaaccggggcgagtgt | SEQ ID<br>NO: 160 |

Binding Protein 21 Amino Acid Sequences

| | | |
|---|---|---|
| Heavy<br>chain<br>A | qvhltqsgpevrkpgtsvkvsckapgntlktydlhwvrsvpgqglqwmgwish<br>egdkkviverfkakvtidwdrstntaylqlsgltsgdtavyycakgskhrlrdyaly<br>dddgalnwavdvdylsnlefwgqgtavtvssastkgpsvflaplapsskstsggtaal<br>gclvkdyfpepvtvswnsgaltsgvhtfpavlqssglyslssvvtvpssslgtqtyi<br>cnvnhkpsntkvdkkvepkscdkthtcppcpapellggpsvflfppkpkdtlmi<br>srtpevtcvvvdvshedpevkfnwyvdgvevhnakttkpreegynstyrvvsvlt<br>vlhqdwlngkeykckvsnkalpapiektiskakgqprepqvctlppsrdeltknq<br>vslscavkgfypsdiavewesngqpennykttppvldsdgsfflvskltvdksrw<br>qqgnvfscsvmhealhnhytqkslslspg | SEQ ID<br>NO: 161 |
| Light<br>chain<br>A | dfvltqsphslsvtpgesasisckssshslihgdrnnylawyvqkpgrspqlliylass<br>rasgvpdrfsgsgsdkdftlkisrvetedvgtyycmqgrespwtfgqgtkvdikrt<br>vaapsvfifppsdeqlksgtasvvcllnnfypreakvqwkvdnalqsgnsqesvt<br>eqdskdstyslsstltlskadyekhkvyacevthqglsspvtksfnrgec | SEQ ID<br>NO: 162 |
| Heavy<br>chain<br>B | Evrlvesgggglvkpggslrlscsasgfdfdnawmtwvrqppgkglewv<br>ngritgpgegwsvdyaesvkgrftisrdntkntlylemnnvrtedtgyyfcar<br>tgkyydfwsgyppgeeyfqdwgqgtlvivssdktht<br>rahlvqsgstamkkpgasvrvscqtsgytftahilfwfrqapgrglewvgw<br>ikpqygavnfgggfrdrvtltrdvyreiaymdirglkpddtavyycardrs<br>ygdsswaldawgqgttvvvsadkthtastkgpsvflaplapsskstsggtaal<br>gclvkdyfpepvtvswnsgaltsgvhtfpavlqssglyslssvvtvpssslg<br>tqtyicnvnhkpsntkvdkkvepkscdkthtcppcpapellggpsvflfp<br>pkpkdtlmisrtpevtcvvvdvshedpevkfnwyvdgvevhnakttkpr<br>eeqynstyrvvsvltvlhqdwlngkeykckvsnkalpapiektiskakgq<br>prepqvytlppcrdeltknqvslwclvkgfypsdiavewesngqpenny<br>kttppvldsdgsfflyskltvdksrwqqgnvfscsvmhealhnhytqksls<br>lspg | SEQ ID<br>NO: 163 |
| Light<br>chain<br>B | tyihvtqspsslsvsigdrvtincqtsqgvgsdlhwyqhkpgrapkllihhtssved<br>gvpsrfsgsgfhtsfnltisdlqaddiatyycqvlqffgrgsrlhikdkthtaseltqd<br>pavsvalkqtvtitcrgdslrshyaswyqkkpgqapvllfygknnrpsgipdrfsg<br>sasgnraslttitgaqaedeadyycssrdksgsrlsvfgggtkltvldkthtrtvaapsv<br>fifppsdeqlksgtasvvcllnnfypreakvqwkvdnalqsgnsqesvteqdskd<br>styslsstltlskadyekhkvyacevthqglsspvtksfnrgec | SEQ ID<br>NO: 164 |

Binding Protein 21 Nucleotide Sequences

| | | |
|---|---|---|
| Heavy<br>chain<br>A | caggtgcacctgacacagagcggacccgaagtgcggaagcctggcacctctgtga<br>aggtgtcctgcaaggcccctggcaacaccctgaaaacctacgacctgcactgggtg<br>cgcagcgtgccaggacagggactgcagtggatgggctggatcagccacgagggc<br>gacaagaaagtgatcgtggaacggttcaaggccaaagtgaccatcgactgggaca<br>gaagcaccaacaccgcctacctgcagctgagcggcctgacctctggcgataccgc<br>cgtgtactactgcgccaagggcagcaagcaccggctgagagactacgccctgtac<br>gacgatgacggcgcccctgaactgggccgtggatgtggactacctgagcaacctgg<br>aattctggggccagggcacagccgtgaccgtgtcatctgcttcgaccaagggcccc<br>agcgtgttccctctggcccctagcagcaagagcacatctggcggaacagccgccct<br>gggctgcctcgtgaaggactactttcccgagcccgtgaccgtgtcctggaattctggc | SEQ ID<br>NO: 165 |

TABLE 2-continued

Heavy and light chain sequences of binding proteins. CDR sequences are bolded and italicized.

| | | |
|---|---|---|
| | gccctgaccagcggcgtgcacacctttccagctgtgctgcagtccagcggcctgtac<br>agcctgagcagcgtcgtgacagtgcccagcagctctctgggcacccagacctacat<br>ctgcaacgtgaaccacaagcccagcaacaccaaggtggacaagaaggtggaacc<br>caagagctgcgacaagacccacacctgtcccccttgtcctgcccccgaactgctgg<br>gaggcccttccgtgacctgaccccccaaagcccaaggacaccctgatgatcagcc<br>ggaccccgaagtgacctgcgtggtggtggatgtgtcccacgaggaccctgaagtg<br>aagttcaattggtacgtggacggcgtggaagtgcacaacgccaagaccaagccaa<br>gagaggaacagtacaacagcacctaccgggtggtgtccgtgctgaccgtgctgcac<br>caggactggctgaacggcaaagagtacaagtgcaaggtgtccaacaaggccctgc<br>ctgcccccatcgagaaaaccatcagcaaggccaagggccagccccgcgaaccccc<br>aggtgtgcacactgcccccaagcagggacgagctgaccaagaaccaggtgtccct<br>gagctgtgccgtgaaaggcttctaccctccgatatcgccgtggaatgggagagca<br>acggccagcccgagaacaactacaagaccaccccctgtgctggacagcgacg<br>gctcattcttcctggtgtccaagctgacagtggacaagtcccggtggcagcagggca<br>acgtgacagctgctccgtgatgcacgaggccctgcacaaccactacacccagaagt<br>ccctgagcctgagccccggcaag | |
| Light<br>chain<br>A | gacttcgtgctgacccagagccctcacagcctgagcgtgacacctggcgagagcg<br>ccagcatcagctgcaagagcagccactccctgatccacggcgaccggaacaacta<br>cctggcttggtacgtgcagaagcccggcagatcccccagctgctgatctacctggc<br>cagcagcagagccagcggcgtgcccgatagattactggcagcggcagcgacaag<br>gacttcaccctgaagatcagccgggtggaaaccgaggacgtgggcacctactactg<br>tatgcagggcagagagagcccctggacctttggccagggcaccaaggtggacatc<br>aagcgtacggtggccgctcccagcgtgacatcttcccaccagcgacgagcagctg<br>aagtccggcacagcctctgtcgtgtgcctgctgaacaacttctaccccgcgaggcc<br>aaagtgcagtggaaggtggacaacgccctgcagagcggcaacagccaggaaagc<br>gtgaccgagcaggacagcaaggactccacctacagcctgagcagcaccctgacac<br>tgagcaaggccgactacgagaagcacaaggtgtacgcctgcgaagtgacccacca<br>gggcctgtctagccccgtgaccaagagcttcaaccggggcgagtgt | SEQ ID<br>NO: 166 |
| Heavy<br>chain<br>B | gaggttagactggtggagtcaggagggggcttgtgaagcccggtgggtctctccg<br>cctgagctgactgcctccggctttgatttcgataacgcctggatgacctgggtcaggc<br>agcctccaggtaagggactggagtgggtgggaagaatcacaggtccaggcgagg<br>gctggtccgtggactacgcggaatctgttaaagggcggtttacaatctcaagggaca<br>ataccaagaataccttgtataggagatgaacaacgtgagaactgaagacaccggat<br>attacttctgtgccagaacaggcaaatactacgacttctggtccggctatcccctggc<br>gaggaatattacaagactgggtcagggaaccccttgttatcgtgtcctccgacaaaa<br>cccataccagagcccacctggtgcagtctggcaccgccatgaagaaaccaggcgc<br>ctctgtgcgggtgtcctgtcagacaagcggctacaccttcaccgcccacatcctgact<br>ggttccggcaggcccctggcagaggactggaatgggtgggatggatcaagccca<br>gtatggcgccgtgaacttcggcggaggcttccgggatagagtgaccctgaccgggg<br>acgtgtaccgcgagatcgcctacatggacatccggggcctgaagcccgatgacacc<br>gccgtgtactactgcgccagagacagaagctacggcgacagcgtgtgggctctgg<br>atgcttggggccagggcacaaccgtggtggtgtctgccgataagacccacaccgct<br>tccaccaagggcccatcggtcttccccctggcaccctcctccaagagcacctctggg<br>ggcacagcggccctgggctgcctggtcaaggactacttccccgaaccggtgacggt<br>gtcgtggaactcaggcgccctgaccagcggcgtgcacaccttcccggctgtcctac<br>agtcctcaggactctactccctcagcagcgtggtgaccgtgccctccagcagcttgg<br>gcacccagacctacatctgcaacgtgaatcacaagcccagcaacaccaaggtgga<br>caagaaagttgagcccaaatcttgtgacaaaactcacacatgcccaccgtgcccagc<br>acctgaactcctgggggaccgtcagtcttcctcttcccccccaaaacccaaggacac<br>cctcatgatctcccggacccctgaggtcacatgcgtggtggtggacgtgagccacg<br>aagaccctgaggtcaagttcaactggtatgttgacggcgtggaggtgcataatgcca<br>agacaaagccgcgggaggagcagtacaacagcacgtaccgtgtggtcagcgtcct<br>caccgtcctgcaccaggactggctgaatggcaaggagtacaagtgcaaggtctcca<br>acaaagcccccagccccatcgagaaaaccatctccaaagccaaagggcagcc<br>ccgagaaccacaggtgtacaccctgcccccatgcgggatgagctgaccaagaat<br>caagtcagcctgtggtgcctggtaaaaggcttctatcccagcgacatcgccgtggag<br>tgggagagcaatgggcagccggagaacaactacaagaccacgcctcccgtgctgg<br>actccgacggctccttcttcctctactcaaaactcaccgtggacaagagcaggtggca<br>gcaggggaacgtcttctcatgctccgtgatgcatgaggctctgcacaaccactacac<br>gcagaagagcctctccctgtctccgggt | SEQ ID<br>NO: 167 |
| Light<br>chain<br>B | tacatccacgtgacccagagccccagcagcctgtccgtgtccatcggcgacagagt<br>gaccatcaactgccagacctctcagggcgtgggcagcgacctgcactggtatcagc<br>acaagcctggcagagccccaagctgctgatccaccacacaagcagcgtggaaga<br>tggcgtgcccagcagattaccggcagcggcttccacaccagcttcaacctgaccat<br>cagcgatctgcaggccgacgacattgccacctactattgtcaggtgctgcagttcttc<br>ggcagaggcagcagactgcacatcaaggacaaaaccataccgcatccgaactga<br>ctcaggaccctgccgtctctgtggcactgaagcagactgtgactattactttgccgagg<br>cgactcactgcggagccactacgcttcctggtatcagaagaaacccggccaggcac<br>ctgtgctgctgttctacggaaagaacaatggccatctggcatccccgaccgcttact<br>ggcagtgcatcagggaaccgagccagtctgaccattaccggcgcccaggctgagg<br>acgaagccgattactattgcagctcccgggataagagcggctccagactgagcgtgt<br>tcggaggaggaactaaactgaccgtcctcgataagacccataccgtacggtggcc<br>gctcccagcgtgacatcttcccacctagcgacgagcagctgaagtccggcacagcc<br>tctgtcgtgtgcctgctgaacaacttctaccccgcgaggccaaagtgcagtggaag | SEQ ID<br>NO: 168 |

TABLE 2-continued

Heavy and light chain sequences of binding proteins. CDR sequences are bolded and italicized.

```
gtggacaacgccctgcagagcggcaacagccaggaaagcgtgaccgagcagga
cagcaaggactccacctacagcctgagcagcaccctgacactgagcaaggccgac
tacgagaagcacaaggtgtacgcctgcgaagtgacccacagggcctgtctagccc
cgtgaccaagagcttcaaccggggcgagtgt
```

Binding Protein 22 Amino Acid Sequences

| | | |
|---|---|---|
| Heavy chain A | qvhltqsgpevrkpgtsvkvsckapgntlktydlhwvrsvpgqglqwmgwish egdkkviverfkakvtidwdrstntaylqlsgltsgdtavyycakgskhrlrdyaly dddgalnwavdvdylsnlefwgqgtavtvssastkgpsvfplapssktsggtaal gclvkdyfpepvtvswnsgaltsgvhtfpavlqssglyslssvvtvpssslgtqtyi cnvnhkpsntkvdkkvepkscdkthtcppcpapellggpsvflfppkpkdtlmi srtpevtcvvvdvshedpevkfnwyvdgvevhnaktkpreegynstyrvvsvlt vlhqdwlngkeykckvsnkalpapiektiskakgqprepqvctlppsrdeltknq vslscavkgfypsdiavewesngqpennykttppvldsdgsfflvskltvdksrw qqgnvfscsvmhealhnhytqkslslspg | SEQ ID NO: 169 |
| Light chain A | dfvltqspshslsvtpgesasisckssshslihgdrnnylawyvqkpgrspqlliylass rasgvpdrfsgsgsdkdftlkisrvetedvgtyycmqgrespwtfgqgtkvdikrt vaapsvfifppsdeqlksgtasvvcllnnfypreakvqwkvdnalqsgnsqesvt eqdskdstyslsstltlskadyekhkvyacevthqglsspvtksfnrgec | SEQ ID NO: 170 |
| Heavy chain B | rahlyqsgtamkkpgasvrvscqtsgytftahilfwfrqapgrglewvgw inikpqygavnfgggfrdrvtltrdvyreiaymdirglkpddtavyycardrs ygdsswaldawgqgttvvvsadkthtevrlvesgglvkpggslrlscsas gfdfdnawmtwvrqppgkglewvgritgpgegwsvdyaesykgrftis rdntkntlylemnnvrtedtgyyfcartgkyydfwsgyppgeeyfqdwg qgtlvivssdkthtastkgpsvfplapssktsggtaalgclvkdyfpepvtv swnsgaltsgvhtfpavlqssglyslssvvtvpssslgtqtyicnynhkpsnt kvdkkvepkscdkthtcppcpapellggpsvflfppkpkdtlmisrtpevt cvvvdvshedpevkfnwyvdgvevhnaktkpreeqynstyrvvsvltvl hqdwlngkeykckvsnkalpapiektiskakgqprepqvytlppcrdelt knqvslwclykgfypsdiavewesngqpennykttppvldsdgsf | SEQ ID NO: 171 |
| Light chain B | aseltqdpavsvalkqtvtitcrgdslrshyaswyqkkpgqapvllfygknnrpsg ipdrfsgsasgnrasltitgaqaedeadyycssrdksgsrlsvfgggtkltvldktht Yihvtqspsslsvsigdrvtincqtsqgvgsdlhwyqhkpgrapkllihhtssved gvpsrfsgsgfhtsfnltisdlqaddiatyycqvlqffgrgsrlhik dkthtrtvaapsvfifppsdeqlksgtasvvcllnnfypreakvqwkvdnalqsgn sqesvteqdskdstyslsstltlskadyekhkvyacevthqglsspvtksfnrgec | SEQ ID NO: 172 |

Binding Protein 22 Nucleotide Sequences

| | | |
|---|---|---|
| Heavy chain A | caggtgcacctgacacagagcggacccgaagtgcggaagcctggcacctctgtga aggtgtcctgcaaggcccctggcaacaccctgaaaacctacgacctgcactgggtg cgcagcgtgccaggacagggactgcagtggatgggctggatcagccacgagggc gacaagaaagtgatcgtggaacggacaaggccaaagtgaccatcgactgggaca aagcaccaacaccgcctacctgcagctgagcggcctgacctctggcgataccgc cgtgtactactgcgccaagggcagcaagcaccggctgagagactacgccctgtac gacgatgacggcgccctgaactgggccgtggatgtggactacctgagcaacctgg aattctgggggccagggcacagccgtgaccgtgtcatctgcttcgaccaagggcccc agcgtgaccctctggccctagcagcaagagcacatctggcggaacagccgcct gggctgcctcgtgaaggactacttttcccgagcccgtgaccgtgtcctggaattctgc gccctgaccagcggcgtgcacacctttccagctgtgctgcagtcagcggcctgtac agcctgagcagcgtcgtgacagtgcccagcagctctctgggcacccagacctacat ctgcaacgtgaaccacaagcccagcaacaccaaggtggacaagaaggtgaacc caagagctgcgacaagacccacacctgtccccttgtcctgccccgaactgctgg gaggcccttccgtgttcctgttccccaaagcccaaggacaccctgatgatcagcc ggaccccgaagtgacctgcgtggtggtggatgtgtcccacgaggaccctgaagtg aagttcaattggtacgtggacggcgtggaagtgcacaacgccaagaccaagccaa gagaggaacagtacaacagcacctaccgggtggtgtccgtgctgaccgtgctgcac caggactggctgaacggcaaagagtacaagtgcaaggtgtccaacaaggccctgc ctgccccatcgagaaaaccatcagcaaggccaagggccagccccgcgaacccc aggtgtgcacactgccccaagcagggacgagctgaccaagaaccaggtgtccct gagctgtgccgtgaaaggcttctaccccctccgatatcgccgtggaatgggagagca acggccagcccgagaacaactacaagaccacccccctgtgctggacagcgacg gctcattcttcctggtgtccaagctgacagtggacaagtcccggtggcagcagggca acgtgttcagctgctccgtgatgcacgaggccctgcacaaccactacacccagaagt ccctgagcctgagccccggcaag | SEQ ID NO: 173 |
| Light chain A | tgacttcgtgctgacccagagccctcacagcctgagcgtgacacctggcgagagcg cagccatcagctgcaagagcagccactccctgatccacggcgaccggaacaacta cctggcttggtacgtgcagaagcccggcagatcccccagctgctgatctacctggc cagcagcagagccagcggcgtgcccgatagattttctggcagcggcagcgacaag gacttcaccctgaagatcagccgggtggaaaccgaggacgtgggcacctactactg tatgcagggcagagagagcccctgacctttggccagggcaccaaggtggacatc aagcgtacggtggccgctcccagcgtgacatcttccaccctagcgacgagcagctg | SEQ ID NO: 174 |

TABLE 2-continued

Heavy and light chain sequences of binding proteins. CDR sequences are bolded and italicized.

|  |  |  |
|---|---|---|
|  | aagtccggcacagcctctgtcgtgtgcctgctgaacaacttctaccccgcgaggcc aaagtgcagtggaaggtggacaacgccctgcagagcggcaacagccaggaaagc gtgaccgagcaggacagcaaggactccacctacagcctgagcagcaccctgacac tgagcaaggccgactacgagaagcacaaggtgtacgcctgcgaagtgacccacca gggcctgtctagccccgtgaccaagagcttcaaccggggcgagtgt |  |
| Heavy chain B | agagcccacctggtgcagtctggcaccgccatgaagaaaccaggcgcctctgtgc agggtgtcctgtcagacaagcggctacaccttcaccgcccacatcctgttctggttccg gcaggcccctggcagaggactggaatgggtgggatggatcaagcccagtatggc gccgtgaacttcggcggaggcttcgggatagagtgaccctgacccgggacgtgta ccgcgagatcgcctacatggacatccgggcctgaagccgatgacaccgccgtg tactactgcgccagagacagaagctacggcgacagcagctgggctctggatgcttg gggccagggcacaaccgtggtggtgtctgccgacaaaacccataccgaggttaga ctggtggagtcaggaggggggcttgtgaagcccggtgggtctctccgcctgagctg ttctgcctccgggctttgatttcgataacgcctggatgacctggtgcaggcagcctccag gtaagggactggagtgggtgggaagaatcacaggtccaggcgagggctggtccgt ggactacgcggaatctgttaaagggcggtttacaatctcaagggacaataccaagaa taccttgtatttggagatgaacaacgtgagaactgaagacaccggatattacttctgtg ccagaacaggcaaatactacgacttctggtccggctatcccctggcgaggaatattt tcaagactgggtcagggaaccccttgttatcgtgtcctccgataagacccacaccgct tccaccaagggcccatcggtcttcccctggcaccctcctccaagagcacctctggg ggcacagcggcctgggctgcctggtcaaggactacttccccgaaccggtgacggt gtcgtggaactcaggcgccctgaccagcggcgtgcacaccttcccggctgtcctac agtcctcaggactctactccctcagcagcgtggtgaccgtgccctccagcagcttgg gcacccagacctacatctgcaacgtgaatcacaagcccagcaacaccaaggtgga caagaaagttgagcccaaatcttgtgacaaaactcacacatgcccaccgtgcccagc acctgaactcctggggggaccgtcagtcttcctcttccccccaaaacccaaggacac cctcatgatctcccggacccctgaggtcacatgcgtggtggtggacgtgagccacg aagaccctgaggtcaagttcaactggtatgttgacggcgtggaggtgcataatgcca agacaaagccgcgggaggagcagtacaacagcacgtaccgtgtggtcagcgtcct caccgtcctgcaccaggactggctgaatggcaaggagtacaagtgcaaggtctcca acaaagccctcccagcccccatcgagaaaaccatctccaaagccaaagggcagcc ccgagaaccacaggtgtacaccctgcccccatgccgggatgagctgaccaagaat caagtcagcctgtggtgcctggtaaaaggcttctatcccagcgacatcgccgtggag tgggagagcaatgggcagccggagaacaactacaagaccacgcctcccgtgctgg actccgacggctccttcttcctctactcaaaactcaccgtggacaagagcaggtggca gcaggggaacgtcttctcatgctccgtgatgcatgaggctctgcacaaccactacac gcagaagagcctctccctgtctccgggt | SEQ ID NO: 175 |
| Light chain B | gcatccgaactgactcaggaccctgccgtctctgtggcactgaagcagactg tgactattacttgccgaggcgactcactgcggagccactacgcttcctggtatc agaagaaacccggccaggcacctgtgctgctgttctacggaaagaacaata ggccatctggcatcccgaccgcttttctggcagtgcatcaggggaaccgagc cagtctgaccattaccggcgcccaggctgaggacgaagccgattactattgc agctcccgggataagagcggctccagactgagcgtgttcggaggaggaact aaaactgaccgtcctcgacaaaacccatacctacatccacgtgacccagagcc ccagcagcctccgtgtccatcggcgacagagtgaccatcaactgccaga cctctcagggcgtgggcagcgacctgcactggtatcagcacaagcctggca gagccccaagctgctgatccaccacacaagcagcgtggaagatggcgtg cccagcagatttccggcagcggcttccacaccagcttgcaacctgaccatca gcgatctgcaggccgacgacattgccacctactattgtcaggtgctgcagttc ttcggcagaggcagcagactgcacatcaaggataagacccatacccgtacg gtggccgctcccagcgtgttcatcttcccacctagcgacgagcagctgaagt ccggcacagcctctgtcgtgtgcctgctgaacaacttctaccccgcgaggc caaagtgcagtggaaggtggacaacgccctgcagagcggcaacagccag gaaagcgtgaccgagcaggacagcaaggactccacctacagcctgagcag caccctgacactgagcaaggccgactacgagaagcacaaggtgtacgcct gcgaagtgacccaccagggcctgtctagccccgtgaccaagagcttcaacc ggggcgagtgt | SEQ ID NO: 176 |
| Binding Protein 23 Amino Acid Sequences |  |  |
| Heavy chain A | evrlvesgggglvkpggslrlscsasgfdfdnawmtwvrqppgkglewvgritgp gegwsvdyaesvkgrftisrdntkntlylemnnvrtedtgyyfcartgkyydfws gyppgeeyfqdwgqgtlvivssastkgpsvfplapsskstsggtaalgclvkdyfp epvtvswnsgaltsgvhtfpavlqssglyslssvvtvpssslgtqtyicnvnhkpsn tkvdkkvepkscdkthtcppcpapellggpsvflfppkpkdtlmisrtpevtcvv vdvshedpevkfnwyvdgvevhnaktkpreeqynstyrvvsvltvlhqdwlng keykckvsnkalpapiektiskakgqprepqvctlppsrdeltknqvslscavkgf ypsdiavewesngqpennykttppvldsdgsfflvskltvdksrwqqgnvfscs vmhealhnhytqkslslspg | SEQ ID NO: 177 |
| Light chain A | seltqdpavsvalkqtvtitcrgdslrshyaswyqkkpgqapvllfygknnrps gipdrfsgsasgnrasltitgaqaedeadyycssrdksgsrlsvfgggtkltvlsqpk aapsvtlfppsseelqankatlvclisdfypgavtvawkadsspvkagvetttpsk qsnnkyaassylsltpeqwkshrsyscqvthegstvektvaptecs | SEQ ID NO: 178 |

TABLE 2-continued

Heavy and light chain sequences of binding proteins. CDR sequences are bolded and italicized.

| | | |
|---|---|---|
| Heavy chain B | rahlvqsgtamkkpgasvrvscqtsgytftahilfwfrqapgrglewvgw inikpqygavnfgggfrdrvtltrdvyreiaymdirglkpddtavyycardrs ygdsswaldawgqgttvvvsadkthtQvhltqsgpevrkpgtsvkvsck apgntlktydlhwvrsvpgqglqwmgwishegdkkviverfkakvtid wdrstntaylqlsgltsgdtavyycakgskhrlrdyalydddgalnwavd vdylsnlefwgqgtaytvssdkthtastkgpsvfplapssktsggtaalgcl vkdyfpepvtvswnsgaltsgvhtfpavlqssglyslssvvtvpssslgtqt yicnvnhkpsntkvdkkvepkscdkthtcppcpapellggpsvflfppk pkdtlmisrtpevtcvvvdvshedpevkfnwyvdgvevhnaktkpree qynstyrvvsvltvlhqdwlngkeykckvsnkalpapiektiskakgqpr epqvytlppcrdeltknqvslwclvkgfypsdiavewesngqpennyktt ppvldsdgsfflyskltvdksrwqqgnvfscsvmhealhnhytqkslsls pg | SEQ ID NO: 179 |
| Light chain B | dfvltqsphslsvtpgesasiscksshslihgdrnnylawyvqkpgrspqlliylas srasgvpdrfsgsgsdkdftlkisrvetedvgtyycmqgrespwtfgqgtkvdik dktht yihvtqspsslsvsigdrvtincqtsqgvgsdlhwyqhkpgrapkllihhtssved gvpsrfsgsgfhtsfnltisdlqaddiatyycqvlqffgrgsrlhikdkthtrtvaaps vfifppsdeqlksgtasvvcllnnfypreakvqwkvdnalqsgnsqesvteqdsk dstyslsstltlskadyekhkvyacevthqglsspvtksfnrgec | SEQ ID NO: 180 |

Binding Protein 23 Nucleotide Sequences

| | | |
|---|---|---|
| Heavy chain A | gaggttagactggtggagtcaggaggggggcttgtgaagcccggtgggtctctccg cctgagctgactgcctccggctttgatttcgataacgcctggatgacctgggtcaggc agcctccaggtaagggactggagtgggtgggagaatcacagctccaggcgagg gctggtccgtgactacgcggaatctgttaaagggcggtttacaatctcaagggaca ataccaagaataccttgtatttggagatgaacaacgtgagaactgaagacaccggat attacttctgtgccagaacaggcaaatactacgacttctggtccggctatcccctggc gaggaatattttcaagactggggtcagggaacccttgttatcgtgctccgcgtcga ccaagggccccagcgtgttccctctggccccctagcagcaagagcacatctggcgga acagccgccctgggctgcctcgtgaaggactactttcccgagcccgtgaccgtgtcc tggaattctggcgccctgaccagcggcgtgcacacctttccagctgtgctgcagtcc agcggcctgtacagcctgagcagcgtcgtgacagtgcccagcgctctctgggcac ccagacctacatctgcaacgtgaaccacaagcccagcaacaccaaggtggacaag aaggtggaacccaagagctgcgacaagacccacacctgtcccccttgtcctgcccc cgaactgctgggaggcccttccgtgttcctgacccccaaagcccaaggacaccct gatgatcagccggacccccgaagtgacctgcgtggtggtggatgtgtcccacgagg accctgaagtgaagttcaattggtacgtggacggcgtggaagtgcacaacgccaag accaagccaagagaggaacagtacaacagcacctaccgggtggtgtccgtgctga ccgtgctgcaccaggactggctgaacggcaaagagtacaagtgcaaggtgtccaa caaggccctgcctgcccccatcgagaaaaccatcagcaaggccaagggccagcc ccgcgaaccccaggtgtgcacactgccccaagcagggacgagctgaccaagaa ccaggtgtccctgagctgtgccgtgaaaggcttctacccctccgatatcgccgtgga atgggagagcaacggccagcccgagaacaactacaagaccaccccccctgtgctg gacagcgacggctcattcttcctggtgtccaagctgacagtggacaagtcccggtgg cagcagggcaacgtgttcagctgctccgtgatgcacgaggccctgcacaaccacta cacccagaagtccctgagcctgagccccggcaag | SEQ ID NO: 181 |
| Light chain A | gcatccgaactgactcaggaccctgccgtctctgtggcactgaagcagactg tgactattacttgccgaggcgactcactgcggagccactacgcttcctggtatc agaagaaacccggccaggcacctgtgctgctgttctacgaaagaacaata ggccatctggcatccccgaccgcttttctggcagtgcatcagggaaccgagc cagtctgaccattaccggcgcccaggctgaggacgaagccgattactattgc agctcccgggataagagcggctccagactgagcgtgttcggaggagggaact aaactgaccgtcctcagtcagcccaaggctgccccctcggtcactctgttccc gccctcgagtgaggagcttcaagccaacaaggccacactggtgtgtctcata agtgacttctacccgggagccgtgacagtggcctggaaggcagatagcagc cccgtcaaggcgggagtggagaccaccacaccctccaaacaaagcaacaa caagtacgcggccagcagctacctgagcctgacgcctgagcagtggaagtc ccacagaagctacagctgccaggtcacgcatgaagggagcaccgtggaga agacagtggcccctacagaatgttca | SEQ ID NO: 182 |
| Heavy chain B | agagcccacctggtgcagtctggcaccgccatgaagaaaccaggcgcctctgtgc gggtgtcctgtcagacaagcggctacaccttcaccgcccacatcctgttctggaccg gcaggcccctggcagaggactggaatgggtgggatggatcaagcccagtatggc gccgtgaacttcggcggaggcttccgggatagagtgaccctgacccgggacgtgta ccgcgagatcgcctacatggacatccgggcctgaagcccgatgacaccgccgtg tactactgcgccagagacagaagctacggcgacagcagctgggctctggatgcttg gggccagggcacaaccgtggtggtctgccgacaaaacccataccaggtgcac ctgacacagagcggacccgaagtgcggaagcctggcacctctgtgaaggtgtcctg caaggcccctggcaacacccctgaaaacctacgacctgcactgggtgcgcagcgtg ccaggacagggactgcagtggatgggctggatcagccacgagggcgacaagaaa gtgatcgtggaacggacaaggccaaagtgaccatcgactgggacagaagcacca acaccgcctacctgcagctgagcggcctgacctctggcgataccgccgtgtactact gcgccaagggcagcaagcaccggctgagagactacgccctgtacgacgatgacg | SEQ ID NO: 183 |

TABLE 2-continued

Heavy and light chain sequences of binding proteins. CDR sequences are bolded and italicized.

| | | |
|---|---|---|
| | gcgccctgaactgggccgtggatgtggactacctgagcaacctggaattctggggc<br>cagggcacagccgtgaccgtgtcatctgataagacccacaccgcttccaccaaggg<br>cccatcggtcttcccctggcaccctcctccaagagcacctctgggggcacagcgg<br>ccctgggctgcctggtcaaggactacttccccgaaccggtgacggtgtcgtggaact<br>caggcgccctgaccagcggcgtgcacaccttccccggctgtcctacagtcctcagga<br>ctctactccctcagcagcgtggtgaccgtgccctccagcagcttgggcacccagacc<br>tacatctgcaacgtgaatcacaagcccagcaacaccaaggtggacaagaaagttga<br>gcccaaatcttgtgacaaaactcacacatgcccaccgtgcccagcacctgaactcct<br>ggggggaccgtcagtcttcctcttccccccaaaacccaaggacaccctcatgatctc<br>ccggacccctgaggtcacatgcgtggtggtggacgtgagccacgaagaccctgag<br>gtcaagttcaactggtatgttgacggcgtggaggtgcataatgccaagacaaagccg<br>cgggaggagcagtacaacagcacgtaccgtgtggtcagcgtcctcaccgtcctgca<br>ccaggactggctgaatggcaaggagtacaagtgcaaggtctccaacaaagccctcc<br>cagcccccatcgagaaaaccatctccaaagccaaagggcagccccgagaaccac<br>aggtgtacaccctgcccccatgccgggatgagctgaccaagaatcaagtcagcctg<br>tggtgcctggtaaaaggcttctatcccagcgatatcgccgtggagtgggagagcaat<br>gggcagccggagaacaactacaagaccacgcctcccgtgctggactccgacggct<br>ccttcttcctctactcaaaactcaccgtggacaagagcaggtggcagcaggggaac<br>gtcttctcatgctccgtgatgcatgaggctctgcacaaccactacacgcagaagagc<br>ctctccctgtctccgggt | |
| Light<br>chain<br>B | gacttcgtgctgacccagagccctcacagcctgagcgtgacacctggcgag<br>agcgccagcatcagctgcaagagcagccactccctgatccacggcgaccg<br>gaacaactacctggcttggtacgtgcagaagcccggcagatcccccagct<br>gctgatctacctggccagcagcagagccagcggcgtgcccgatagattttct<br>ggcagcggcagcggcgacaaggacttcaccctgaagatcagccgggtggaaac<br>cgaggacgtgggcacctactactgtatgcagggcagagagagccctgga<br>cctttggccagggcaccaaggtggacatcaaggacaaaacccatacctacat<br>ccacgtgacccagagccccagcagcctgtccgtgtccatcggcgacagagt<br>gaccatcaactgccagacctctcagggcgtgggcagcgacctgcactggta<br>tcagcacaagcctggcagagccccaagctgctgatccaccacacaagca<br>gcgtggaagatggcgtgcccagcagatttttccggcagcggcttccacacca<br>gcttcaacctgaccatcagcgatctgcaggccgacgacattgccacctactat<br>tgtcaggtgctgcagttcttcggcagaggcagcagactgcacatcaaggata<br>agacccataccgtacggtggccgctcccagcgtgttcatcttcccacctagc<br>gacgagcagctgaagtccggcacagcctctgtcgtgtgcctgctgaacaact<br>tctaccccgcgaggccaaagtgcagtggaaggtggacaacgccctgcag<br>agcggcaacagccaggaaagcgtgaccgagcaggacagcaaggactcca<br>cctacagcctgagcagcacccctgacactgagcaaggccgactacgagaag<br>cacaaggtgtacgcctgcgaagtgacccaccagggcctgtctagccccgtg<br>accaagagcttcaaccggggcgagtgt | SEQ ID<br>NO: 184 |

Binding Protein 24 Amino Acid Sequences

| | | |
|---|---|---|
| Heavy<br>chain<br>A | evrlvesgggglvkpggslrlscsasgfdfdnawmtwvrqppgkglewvgritgpg<br>egwsvdyaesvkgrftisrdntkntlylemnnvrtedtgyyfcartgkyydfwsgy<br>ppgeeyfqdwgqgtlvivssastkgpsvfplapsskstsggtaalgclvkdyfpep<br>vtvswnsgaltsgvhtfpavlqssglyslssvvtvpssslgtqtyicnvnhkpsntkv<br>dkkvepkscdkthtcppcpapellggpsvflfppkpkdtlmisrtpevtcvvvdvs<br>hedpevkfnwyvdgvevhnaktkpreeqynstyrvvsvltvlhqdwlngkeyk<br>ckvsnkalpapiektiskakgqprepqvctlppsrdeltknqvslscavkgfypsdi<br>avewesngqpennykttppvldsdgsfflvskltvdksrwqqgnvfscsvmhea<br>lhnhytqkslslspg | SEQ ID<br>NO: 185 |
| Light<br>chain<br>A | aseltqdpavsvalkqtvtitcrgdslrshyaswyqkkpgqapvllfygknnrpsgi<br>pdrfsgsasgnrasltitgaqaedeadyycssrdksgsrlsvfgggtkltvlsqpkaa<br>psvtlfppsseelqankatlvclisdfypgavtvawkadsspvkagvetttpskqsn<br>nkyaassylsltpeqwkshrsyscqvthegstvektvaptecs | SEQ ID<br>NO: 186 |
| Heavy<br>chain<br>B | Qvhltqsgpevrkpgtsvkvsckapgntlktydlhwvrsvpgqglqwmg<br>wishegdkkviverfkakvtidwdrstntaylqlsgltsgdtavyycakgsk<br>hrlrdyalydddgalnwavdvdylsnlefwgqgtavtvss<br>dkthtrahlyqsgtamkkpgasvrvscqtsgytftahilfwfrqapgrglew<br>vgwikpqygavnfgggfrdrvtltrdyyreiaymdirglkpddtavyycar<br>drsygdsswaldawgqgttvvvsadktht astkgpsvfplapssskstsggta<br>algclvkdyfpepvtvswnsgaltsgvhtfpavlqssglyslssvvtvpsssl<br>gtqtyicnvnhkpsntkvdkkvepkscdkthtcppcpapellggpsvflfp<br>pkpkdtlmisrtpevtcvvvdvshedpevkfnwyvdgvevhnaktkpre<br>eqynstyrvvsvltvlhqdwlngkeykckvsnkalpapiektiskakgqpr<br>epqvytlppcrdeltknqvslwclykgfypsdiavewesngqpennyktt<br>ppvldsdgsfflyskltvdksrwqqgnvfscsvmhealhnhytqkslslsp<br>g | SEQ ID<br>NO: 187 |
| Light<br>chain<br>B | tyihvtqspssslsvsigdrvtincqtsqgvgsdlhwyqhkpgrapkllihhtssvedg<br>vpsrfsgsgsgfhtsfnltisdlqaddiatyycqvlqffgrgsrlhikdkthtdfvltqsph<br>slsvtpgesasisckssshslihgdrnnylawyvqkpgrspqlliylassrasgvpdrf<br>sgsgsgdkdftltlkisrvetedvgtyycmqgrespwtfgqgtkvdikdkthtrtvaaps | SEQ ID<br>NO: 188 |

TABLE 2-continued

Heavy and light chain sequences of binding proteins. CDR sequences are bolded and italicized.

vfifppsdeqlksgtasvvcllnnfypreakvqwkvdnalqsgnsqesvteqdskd
styslsstltlskadyekhkvyacevthqglsspvtksfnrgec Binding Protein 24 Nucleotide Sequences

| | | |
|---|---|---|
| Heavy chain A | gaggttagactggtggagtcaggagggggcttgtgaagcccggtgggtctctccgc
ctgagctgttctgcctccggctttgatttcgataacgcctggatgacctgggtcaggca
gcctccaggtaaggggactggagtggtgggaagaatcacaggtccaggcgagggc
tggtccgtggactacgcggaatctgttaaaggcggtttacaatctcaagggacaata
ccaagaatacctttgtatttggagatgaacaacgtgagaactgaagacaccggatattac
ttctgtgccagaacaggcaaatactacgacttctggtccggctatccccctggcgagg
aatattttcaagactggggtcagggaacccttgttatcgtgtcctccgcgtcgaccaag
ggccccagcgtgttccctctggcccctagcagcaagagcacatctggcggaacagc
cgccctgggctgcctcgtgaaggactactttcccgagcccgtgaccgtgtcctggaat
tctggcgccctgaccagcggcgtgcacacctttccagctgtgctgcagtccagcggc
ctgtacagcctgagcagcgtcgtgacagtgcccagcagctctctgggcacccagacc
tacatctgcaacgtgaaccacaagcccagcaacaccaaggtggacaagaaggtgga
acccaagagctgcgacaagacccacacctgtcccccttgtcctgcccccgaactgct
gggaggcccttccgtgttcctgttccccccaaagcccaaggacacctgatgatcagc
cggacccccgaagtgacctgcgtggtggtggatgtgtcccacgaggaccctgaagt
gaagttcaattggtacgtggacggcgtggaagtgcacaacgccaagaccaagccaa
gagaggaacagtacaacagcaccacccgggtggtgtccgtgctgaccgtgctgcac
caggactggctgaacggcaaagagtacaagtgcaaggtgtccaacaaggccctgcc
tgccccccatcgagaaaaccatcagcaaggccaaggccagccccgcgaaccccag
gtgtgcacactgccccaagcagggacgagctgaccaagaaccaggtgtccctgag
ctgtgccgtgaaaggcttctaccctcccgatatcgccgtggaatgggagagcaacgg
ccagcccgagaacaactacaagaccaccccccctgtgctggacagcgacggctcat
tcttcctggtgtccaagctgacagtggacaagtccccggtggcagcagggcaacgtga
cagctgctccgtgatgcacgaggccctgcacaaccactacacccagaagtccctgag
cctgagcccggcaag | SEQ ID NO: 189 |
| Light chain A | gcatccgaactgactcaggaccctgccgtctctgtggcactgaagcagactgt
gactattacttgccgaggcgactcactgcggagccactacgcttcctggtatca
gaagaaaccggccaggcacctgtgctgctgttctacggaaagaacaatagg
ccatctggcatcccgacgcttactggcagtgcatcagggaaccggagccag
tctgaccattaccggcgcccaggctgaggacgaagccgattactattgcagct
cccgggataagagcggctccagactgagcgtgttcggaggagaactaaac
tgaccgtcctcagtcagcccaaggctgccccctcggtcactctgttcccgccct
cgagtgaggagcttcaagccaacaaggccacactggtgtgtctcataagtgac
ttctacccgggagccgtgacagtggcctggaaggcagatagcagccccgtca
aggcgggagtggagaccaccacaccctccaaacaaagcaacaacaagtac
gcggccagcagctacctgagcctgacgcctgagcagtggaagtcccacaga
agctacagctgccaggtcacgcatgaagggagcaccgtggagaagacagtg
gcccctacagaatgttca | SEQ ID NO: 190 |
| Heavy chain B | tacatccacgtgacccagagccccagcagcctgtccgtgtccatcggcgacagagtg
accatccaactgccagacctctcagggcgtgggcagcgacctgcactggtatcacac
aagcctggcagagcccccaagctgctgatccaccacacaagcagcgtggaagatgg
cgtgcccagcagattaccggcagcggcttccacaccagcttcaacctgaccatcagc
gatctgcaggccgacgacattgccacctactattgtcaggtgctgcagttcttcggcag
aggcagcagactgcacatcaaggacaaaaacccataccgacttcgtgctgacccaga
gccctcacagcctgagcgtgacacctggcgagagcgccagcatcagctgcaagag
cagccactccctgatccacggcgaccggaacaactacctggcttggtacgtgcagaa
gcccggcagatccccccagctgctgatctacctggccagcagcagagccagcggc
gtgcccgatagattactggcagcggcagcgacaaggacttcaccctgaagatcagc
cgggtgaaaccgaggacgtgggcacctactactgtatgcagggcagagagagcc
cctggacctaggccagggcaccaaggtggacatcaaggataagacccataccgta
cggtggccgctcccagcgtgttcatcttcccacctagcgacgagcagctgaagtccg
gcacagcctctgtcgtgtgcctgctgaacaacttctaccccgcgaggccaaagtgca
gtggaaggtggacaacgccctgcagagcggcaacagccaggaaagcgtgaccga
gcaggacagcaaggactccacctacagcctgagcagcaccctgacactgagcaag
gccgactacgagaagcacaaggtgtacgcctgcgaagtgacccaccagggcctgtc
tagccccgtgaccaagagcttcaaccggggcgagtgt | SEQ ID NO: 191 |
| Light chain B | tacatccacgtgacccagagccccagcagcctgtccgtgtccatcggcgaca
gagtgaccatcaactgccagacctctcagggcgtgggcagcgacctgcactg
gtatcagcacaagcctggcagagcccccaagctgctgatccaccacacaagc
agcgtggaagatggcgtgcccagcagattttccggcagcggcttccacacca
gcttcaacctgaccatcagcgatctgcaggccgacgacattgccacctactatt
gtcaggtgctgcagttcttcggcagaggcagcagactgcacatcaaggacaa
aaacccataccgacttcgtgctgacccagagccctcacagcctgagcgtgaca
cctggcgagagcgccagcatcagctgcaagagcagccactccctgatccac
ggcgaccggaacaactacctggcttggtacgtgcagaagcccggcagatcc
cccagctgctgatctacctggccagcagcagagccagcggcgtgcccgat
agattttctggcagcggcagcgacaaggacttcaccctgaagatcagccggg
tggaaaccgaggacgtgggcacctactactgtatgcagggcagagagagcc
cctggaccttttggccagggcaccaaggtggacatcaaggataagacccatac | SEQ ID NO: 192 |

TABLE 2-continued

Heavy and light chain sequences of binding proteins. CDR sequences are bolded and italicized.

```
ccgtacggtggccgctcccagcgtgttcatcttcccacctagcgacgagcagc
tgaagtccggcacagcctctgtcgtgtgcctgctgaacaacttctaccccgcg
aggccaaagtgcagtggaaggtggacaacgccctgcagagcggcaacagc
caggaaagcgtgaccgagcaggacagcaaggactccacctacagcctgag
cagcaccctgacactgagcaaggccgactacgagaagcacaaggtgtacgc
ctgcgaagtgacccaccagggcctgtctagccccgtgaccaagagcttcaac
cggggcgagtgt
```

Binding Protein 25 Amino Acid Sequences

| | | |
|---|---|---|
| Heavy chain A | qvqlvqsggqmkkpgesmriscrasgyef*dctln*wirlapgkrpewmg*wlkp rggavnyarplqg*vtmtrdvysdtaflelrsltvddtavyfctr*gkncdynwdfeh* wgrgtpvivssastkgpsvfplapssksstsggtaalgclvkdyfpepvtvswnsgal tsgvhtfpavlqssglyslssvvtvpssslgtqtyicnvnhkpsntkvdkkvepksc dkthtcppcpapellggpsvflfppkpkdtlmisrtpevtcvvvdvshedpevkfn wyvdgvevhnaktkpreeqynstyrvvsvltvlhqdwlngkeykckvsnkalpa piektiskakgqprepqvctlppsrdeltknqvslscavkgfypsdiavewesngq pennykttppvldsdgsfflvskltvdksrwqqgnvfscsvlhealhshytqkslsls pg | SEQ ID NO: 193 |
| Light chain A | eteivltqspgtlslspgetaiisc*rtsqygsla*wyqqrpgqaprlviy*sgstraa*gipdrf sgsrwgpdynltisnlesgdfgvyyc*qqyef*gqgtkvqvdikrtvaapsvfifpps deqlksgtasvvcllnnfypreakvqwkvdnalqsgnsqesvteqdskdstyslsst ltlskadyekhkvyacevthqglsspvtksfnrgec | SEQ ID NO: 194 |
| Heavy chain B | evrlvesgggglvkpggslrlscsasgfdfdnawmtwvrqppgkglewvgr initgpgegwsvdyaesvkgrftisrdntkntlylemnnvrtedtgyyfcartg kyydfwsgyppgeeyfqdwgqgtlvivssdkthtqvqlvesgggvvqpg tslrlscaasqfrfdgygmhwvrqapgkglewvasishdgikkyhaekvw grftisrdnskntlylqmnslrpedtalyycakdlredeceewwsdyydfgk qlpcaksrgglvgiadnwgqgtmvtvssdkthtastkgpsvfplapsskts ggtaalgclvkdyfpepvtvswnsgaltsgvhtfpavlqssglyslssvvtvp ssslgtqtyicnvnhkpsntkvdkkvepkscdkthtcppcpapellggpsv flfppkpkdtlmisrtpevtcvvvdvshedpevkfnwyvdgvevhnaktk preeqynstyrvvsvltvlhqdwlngkeykckvsnkalpapiektiskakg qprepqvytlppcrdeltknqvslwclvkgfypsdiavewesngqpenny kttppvldsdgsfflyskltvdksrwqqgnvfscsvlhealhshytqkslsls pg | SEQ ID NO: 195 |
| Light chain B | qsvltqppsvsaapgqkvtiscsgntsnignnfvswyqqrpgrapqlliyetdkrps gipdrfsasksgtsgtlaitglqtgdeadyycatwaaslssarvfgtgtkvivldkthta seltqdpavsvalkqtvtitcrgdslrshyaswyqkkpgqapvllfygknnrpsgip drfsgsasgnrasltitgaqaedeadyycssrdksgsrlsvfgggtkltvldkthtrtva apsvfifppsdeqlksgtasvvcllnnfypreakvqwkvdnalqsgnsqesvteqd skdstyslsstltlskadyekhkvyacevthqglssvtksfnrgec | SEQ ID NO: 196 |

Binding Protein 25 Nucleotide Sequences

| | | |
|---|---|---|
| Heavy chain A | caggtgcagctggtgcagtctggcggccagatgaagaaacccggcgagagcatgc ggatcagctgcagagccagcggctacgagttcatcgactgcaccctgaactggatca gactggcccctggcaagcggcctgagtggatgggatggctgaagcctagaggcgg agccgtgaactacgccagacctctgcagggcagagtgaccatgaccggacgtgt acagcgataccgccttcctggaactgcggagcctgaccgtggatgataccgccgtgt acttctgcacccggggcaagaactgcgactacaactgggacttcgagcactggggca gaggcacccctgtgatcgtgtcaagcgcgtcgaccaagggccccagcgtgttccctc tggcccctagcagcaagagcacatctggcggaacagccgcctgggctgcctcgtg aaggactactttcccgagcccgtgaccgtgtcctggaattctggcgccctgaccagcg gcgtgcacacctttccagctgtgctgcagtccagcggcctgtacagcctgagcagcgt cgtgacagtgcccagcagctctctgggcacccagacctacatctgcaacgtgaacca caagcccagcaacaccaaggtggacaagaaggtggaaccaagagctgcgacaag acccacacctgtcccccttgtcctgccccgaactgctgggaggcccttccgtgttcct gttcccccaaagcccaaggacacccctgatgatcagccgaccccgaagtgacct gcgtggtggtggatgtgtcccacgaggaccctgaagtgaagttcaattggtacgtgga cggcgtggaagtgcacaacgccaagaccaagccaagagaggaacagtacaacagc acctacggtggtgtccgtgctgaccgtgctgcaccaggactggctgaacggcaaa gagtacaagtgcaaggtgtccaacaaggcctgcctgcccccatcgagaaaaccatc agcaaggccaagggccagccccgcgaaccccaggtgtgcacactgccccaagca gggacgagctgaccaagaaccaggtgtccctgagctgtgccgtgaaaggcttctacc cctccgatatcgccgtggaatgggagagcaacggccagccgacaactacaag accaccccctgtgctggacagcgacggctcattcttcctggtgtccaagctgaccgt ggacaagtcccggtggcagcagggcaacgtgttcagctgctccgtgctgcatgaggc tctgcacagccactacacgcagaagagcctctccctgtctccgggt | SEQ ID NO: 197 |
| Light chain A | gagatcgtgctgacacagagccctggcaccctgagcctgtctccaggcgagacagc catcatcagctgccggacaagccagtacggcagcctggcctggtatcagcagaggc ctggacaggcccccagactcgtgatctacagcggcagcacaagagccgcggaatc cccgatagattcagcggctccagatggggccctgactacaacctgaccatcagcaac | SEQ ID NO: 198 |

TABLE 2-continued

Heavy and light chain sequences of binding proteins. CDR sequences are bolded and italicized.

| | | |
|---|---|---|
| | ctggaaagcggcgacttcggcgtgtactactgccagcagtacgagttcttcggccagg gcaccaaggtgcaggtggacatcaagcgtacggtggccgctcccagcgtgttcatctt cccacctagcgacgagcagctgaagtccggcacagcctctgtcgtgtgcctgctgaa caacttctaccccgcgaggccaaagtgcagtggaaggtggacaacgccctgcaga gcggcaacagccaggaaagcgtgaccgagcaggacagcaaggactccacctaca gcctgagcagcaccctgacactgagcaaggccgactacgagaagcacaaggtgtac gcctgcgaagtgacccaccagggcctgtctagccccgtgaccaagagcttcaaccg gggcgagtgt | |
| Heavy chain B | gaggttagactggtggagtcaggaggggggcttgtgaagcccggtgggtctctccgc ctgagctgttctgcctccggctttgatttcgataacgcctggatgacctgggtcaggcag cctccaggtaagggactggagtgggtgggaagaatcacaggtccaggcgagggct ggtccgtggactacgcggaatctgttaaagggcggtttacaatctcaagggacaatac caagaataccttgtatttggagatgaacaacgtgagaactgaagacaccggatattact tctgtgccagaacaggcaaatactacgacttctggtccggctatcccctggcgagga atattttcaagactggggtcagggaaccttgttatcgtgtcctccgacaaaacccatac ccaggtgcagttggtggagtctgggggaggcgtggtccagcctgggacgtccctga gactctcctgtgcagcctctcaattcaggtttgatggttatggcatgcactgggtccgcc aggcccaggcaaggggctggagtgggtggcatctatatcacatgatggaattaaaa agtatcacgcagaaaagtgtgggccgcttcaccatctccagagacaattccaagaa cacactgtatctacaaatgaacagcctgcgacctgaggacacggctctctactactgtg cgaaagatttgcgagaagacgaatgtgaagagtggtggtcggattattacgattttggg aaacaactcccttgcgcaaagtcacgcggcggcttggttggaattgctgataactggg gccaagggacaatggtcaccgtctcttcagataagcccacaccgcttccaccaagg gcccatcggtcttcccctggcaccctcctccaagagcacctctgggggcacagcgg ccctgggctgcctggtcaaggactacttccccgaaccggtgacggtgtcgtggaactc aggcgccctgaccagcggcgtgcacaccttcccggctgtcctacagtcctcaggact ctactcccctcagcagcgtggtgaccgtgccctccagcagcttgggcacccagaccta catctgcaacgtgaatcacaagcccagcaacaccaaggtggacaagaaagttgagc ccaaatcttgtgacaaaactcacacatgcccaccgtgcccagcacctgaactcctggg gggaccgtcagtcttcctcttccccccaaaacccaaggacaccctcatgatctcccgg acccctgaggtcacatgcgtggtggtggacgtgagccacgaagaccctgaggtcaa gttcaactggtatgttgacggcgtggaggtgcataatgccaagacaaagccgcggga ggagcagtacaacagcacgtaccgtgtggtcagcgtcctcaccgtcctgcaccagga ctggctgaatggcaaggagtacaagtgcaaggtctccaacaaagccctcccagcccc catcgagaaaaccatctccaaagccaaagggcagccccgagaaccacaggtgtaca ccctgcccccatgccgggatgagctgaccaagaatcaagtcagcctgtggtgcctgg taaaaggcttctatcccagcgacatcgccgtggagtgggagagcaatgggcagccg gagaacaactacaagaccacgcctcccgtgctggactccgacggctccttcttcctcta ctcaaaactcaccgtggacaagagcaggtggcagcagggaacgtcttctcatgctc cgtgctgcatgaggctctgcacagccactacacgcagaagagcctctccctgtctccg ggt | SEQ ID NO: 199 |
| Light chain B | cagtctgtgctgacgcagccgcccctcagtgtctgcggccccaggacagaagg tcaccatctcctgctctggaaacaccctccaacattggcaataattagtgtcctgg tatcaacagcgcccggcagagcccccaactcctcatttatgaaactgacaa gcgaccctcagggattcctgaccgattctctgcttcaagtctggtacgtcagg caccctggccatcaccgggctgcagactggggacgaggccgattattactgc gccacatgggctgccagcctgagttccgcgcgtgtcttcggaactgggacca aggtcatcgtcctggacaaaacccataccgcatccgaactgactcaggaccct gccgtctctgtggcactgaagcagactgtgactattacttgccgaggcgactca ctgcggagccactacgcttcctggtatcagaagaaacccggcagggcacctg tgctgctgttctacggaaagaacaataggccatctggcatccccgaccgcltttc tggcagtgcatcagggaaccgagccagtctgaccattaccggcgcccaggct gaggacgaagccgattactattgcagctcccgggataagagcggctccagac tgagcgtgttcggaggaggaactaaactgaccgtcctcgataagacccatacc cgtacggtggccgctcccagcgtgttcatcttcccacctagcgacgagcagct gaagtccggcacagcctctgtcgtgtgcctgctgaacaacttctaccccgcg aggccaaagtgcagtggaaggtggacaacgccctgcagagcggcaacagc caggaaagcgtgaccgagcaggacagcaaggactccacctacagcctgag cagcaccctgacactgagcaaggccgactacgagaagcacaaggtgtacgc ctgcgaagtgacccaccagggcctgtctagccccgtgaccaagagcttcaac cggggcgagtgt | SEQ ID NO: 200 |

Binding Protein 26 Amino Acid Sequences

| | | |
|---|---|---|
| Heavy chain A | Rahlvqsgtamkkpgasvrvscqts*gytftahi*fwfrqapgrglewvgw*ikpqy gav*nfgggfrdrvtltrdvyreiaymdirglkpddtavyycard*rsygdsswalda* wgqgttvvvsaastkgpsvfplapsskstsggtaalgclvkdyfpepvtvswnsga ltsgvhtfpavlqssglyslssvvtvpssslgtqtyicnvnhkpsntkvdkkvepksc dkthtcppcpapellggpsvflfppkpkdtlmisrtpevtcvvvdvshedpevkfn wyvdgvevhnakttkpreeqynstyrvvsvltvlhqdwlngkeykckvsnkalpa piektiskakgqprepqvctlppsrdeltknqvslscavkgfypsdiavewesngq pennykttppvldsdgsfflvskltvdksrwqqgnvfscsvlhealhshytqkslsls pg | SEQ ID NO: 201 |

TABLE 2-continued

Heavy and light chain sequences of binding proteins. CDR sequences are bolded and italicized.

| | | |
|---|---|---|
| Light chain A | tyihvtqspsslsvsigdrvtincqts*qgvgsd*hwyqhkpgrapkllihhtssvedg vpsrfsgsgf*hts*fnltisdlqaddiatyyc*qvlqff*grgsrlhikrtvaapsvfifppsd eqlksgtasvvcllnnfypreakvqwkvdnalqsgnsqesvteqdskdstyslsstl tlskadyekhkvyacevthqglsspvtksfnrgec | SEQ ID NO: 202 |
| Heavy chain B | yevrlvesgglvkpggslrlscsasgfdfdnawmtwvrqppgkglewvgr itgpgegwsvdyaesvkgrftisrdntkntlylemnnvrtedtgyyfcartg kyydfwsgyppgeeyfqdwgqgtlvivssdkthtqvqlvesgggvvqpg tslrlscaasqfrfdgygmhwvrqapgkglewvasishdgikkyhaekvw qrftisrdnskntlylqmnslrpedtalyycakdlredeceeewwsdyydfqk qlpcaksrqqlvqiadnwgqgtmvtvssdkthtastkgpsvfplapssksts ggtaalgclvkdyfpepvtvswnsgaltsgvhtfpavlqssglyslssvvtvp ssslgtqtvicnvnhkpsntkvdkkvepkscdkthtcppcpapellgqpsv flfppkpkdtlmisrtpevtcvvvdvshedpevkfnwyvdgvevhnaktk preeqynstyrvvsvltvlhqdwlngkeykckvsnkalpapiektiskakq qprepqvytlppcrdeltknqvslwclvkgfypsdiavewesngqpenny kttppvldsdgsfflyskltvdksrwqqgnvfscsvlhealhshytqkslsls pg | SEQ ID NO: 203 |
| Light chain B | qsvltqppsvsaapgqkvtiscsgntsnignnfvswyqqrpgrapqlliyetdkrps gipdrfsasksgtsgtlaitglqtgdeadyycatwaaslssarvfgtgtkvivldkthta seltqdpavsvalkqtvtitcrgdslrshyaswyqkkpgqapvllfygknnrpsgip drfsgsasgnrasltitgaqaedeadyycssrdksgsrlsvfgggtkltvldkthrtva apsvfifppsdeqlksgtasvvcllnnfypreakvqwkvdnalqsgnsqesvteqd skdstyslsstltlskadyekhkvyacevthqglsspvtksfnrgec | SEQ ID NO: 204 |

Binding Protein 26 Nucleotide Sequences

| | | |
|---|---|---|
| Heavy chain A | gagagcccacctggtgcagtctggcaccgccatgaagaaaccaggcgcctctgtgcg ggtgtcctgtcagacaagcggctacaccttcaccgcccacatcctgactggaccggc aggccctggcagaggactggaatgggtgggatggatcaagcccagtgatggcgcc gtgaacttcggcggaggcttccgggatagagtgaccctgacccgggacgtgtaccgc gagatcgcctacatggacatccggggcctgaagcccgatgacaccgccgtgtactac tgcgccagagacagaagctacggcgacagcagctgggctctggatgcttggggcca gggcacaaccgtggtggtgtctgccgcctctacaaagggcccsagcgtgaccctctg gcccctagcagcaagagcacatctggcggaacagccgccctgggctgcctcgtgaa ggactactacccgagcccgtgaccgtgtcctggaattctggcgccctgaccagcggc gtgcacacctaccagctgtgctgcagtccagcggcctgtacagcctgagcagcgtcg tgacagtgcccagcagctctctgggcacccagacctacatctgcaacgtgaaccaca agcccagcaacaccaaggtggacaagaaggtggaacccaagagctgcgacaagac ccacacctgtcccccttgtcctgcccccgaactgctgggaggcccttccgtgttcctgtt ccccccaaagcccaaggacaccctgatgatcagccggacccccgaagtgacctgcg tggtggtggatgtgtcccacgaggaccctgaagtgaagttcaattggtacgtggacgg cgtggaagtgcacaacgccaagaccaagccaagagggaacagtacaacagcacc taccgggtggtgtccgtgctgaccgtgctgcaccaggactggctgaacggcaaagag tacaagtgcaaggtgtccaacaaggccctgcctgcccccatcgagaaaaccatcagc aaggccaagggccagccccgcgaacccaggtgtgcacactgccccaagcagg gacgagctgaccaagaaccaggtgtccctgagctgtgccgtgaaaggcttctaccct ccgatatcgccgtggaatgggagagcaacggccagcccgagaacaactacaagac cacccccctgtgctggacagcgacggctcattcttcctggtgtccaagctgacagtg gacaagtcccggtggcagcagggcaacgtgttcagctgctccgtgctgcatgaggct ctgcacagccactacacgcagaagagcctctccctgtctccgggt | SEQ ID NO: 205 |
| Light chain A | ttacatccacgtgacccagagccccagcagcctgtccgtgtccatcggcgacagagtg accatcaactgccagacctctcagggcgtgggcagcgacctgcactggtatcagcac aagcctggcagagcccccaagctgctgatccaccacacaagcagcgtggaagatgg cgtgcccagcagattaccggcagcggcttccacaccagcttcaacctgaccatcagc gatctgcaggccgacgacattgccacctactattgtcaggtgctgcagttcttcggcag aggcagcagactgcacatcaagcgtacggtggccgctcccagcgtgttcatcttccca cctagcgacgagcagctgaagtccggcacagcctctgtcgtgtgcctgctgaacaact tctaccccgcgaggccaaagtgcagtggaaggtggacaacgccctgcagagcgg caacagccaggaaagcgtgaccgagcaggacagcaaggactccacctacagcctg agcagcaccctgacactgagcaaggccgactacgagaagcacaaggtgtacgcctg cgaagtgacccaccagggcctgtctagccccgtgaccaagagcttcaacggggcg agtgt | SEQ ID NO: 206 |
| Heavy chain B | gaggttagactggtggagtcaggaggggggcttgtgaagcccggtgggtctctccgc ctgagctgttctgcctccggctttgatttcgataacgcctggatgacctgggtcaggcag cctccaggtaagggactggagtgggtgggaagaatcacaggtccaggcgagggct ggtccgtggactacgcggaatctgttaaagggcggtttacaatctcaaggacaatac caagaataccttgtataggagatgaacaacgtgagaactgaagcaccggatattact tctgtgccagaacaggcaaatactacgactctggtccggctatcccctggcgagga atatttcaagactggggtcagggaaccttgttatcgtgtcctccgacaaaacccatac ccaggtgcagttggtggagtctggggggaggcgttggtccagcctgggacgtccctga gactctcctgtgcagcctctcaattcaggtttgatggttatggcatgcactgggtccgcc aggccccaggcaaggggctggagtgggtggcatctatatcacatgatggaattaaaa agtatcacgcagaaaaagtgtgggccgcttcaccatctccagagacaattccaagaa | SEQ ID NO: 207 |

TABLE 2-continued

Heavy and light chain sequences of binding proteins. CDR sequences are bolded and italicized.

| | |
|---|---|
| cacactgtatctacaaatgaacagcctgcgacctgaggacacggctctctactactgtg<br>cgaaagatttgcgagaagacgaatgtgaagagtggtggtcggattattacgattttggg<br>aaacaactcccttgcgcaaagtcacgcggcggcttggttggaattgctgataactggg<br>gccaagggacaatggtcaccgtctcttcagataagacccacaccgcttccaccaagg<br>gcccatcggtcttccccctggcaccctcctccaagagcacctctgggggcacagcgg<br>ccctgggctgcctggtcaaggactacttccccgaaccggtgacggtgtcgtggaactc<br>aggcgccctgaccagcggcgtgcacaccttcccggctgtcctacagtcctcaggact<br>ctactccctcagcagcgtggtgaccgtgccctccagcagcttgggcacccagaccta<br>catctgcaacgtgaatcacaagcccagcaacaccaaggtggacaagaaagttgagc<br>ccaaatcttgtgacaaaactcacacatgcccaccgtgcccagcacctgaactcctggg<br>gggaccgtcagtcttcctcttccccccaaaacccaaggacaccctcatgatctcccgg<br>acccctgaggtcacatgcgtggtggtggacgtgagccacgaagaccctgaggtcaa<br>gttcaactggtatgttgacggcgtggaggtgcataatgccaagacaaagccgcggga<br>ggagcagtacaacagcacgtaccgtgtggtcagcgtcctcaccgtcctgcaccagga<br>ctggctgaatggcaaggagtacaagtgcaaggtctccaacaaagcccccagcccc<br>atcgagaaaaccatctccaaagccaaagggcagccccgagaaccacaggtgtaca<br>ccctgcccccatgccgggatgagctgaccaagaatcaagtcagcctgtggtgcctgg<br>taaaaggcttctatcccagcgacatcgccgtggagtgggagagcaatgggcagccg<br>gagaacaactacaagaccacgcctcccgtgctggactccgacggctccttcttcctcta<br>ctcaaaactcaccgtggacaagagcaggtggcagcaggggaacgtcttctcatgctc<br>cgtgctgcatgaggctctgcacagccactacacgcagaagagcctctccctgtctccg<br>ggt | |
| Light<br>chain<br>B | cagtctgtgctgacgcagccgccctcagtgtctgcggccccaggacagaaggtcacc<br>atctcctgctctggaaacacctccaacattggcaataattttgtgtcctggtatcaacagc<br>gccccggcagagcccccaactcctcatttatgaaactgacaagcgaccctcaggga<br>ttcctgaccgattctctgcttccaagtctggtacgtcaggcaccctggccatcaccggg<br>ctgcagactggggacgaggccgattattactgcgccacatgggctgccagcctgagtt<br>ccgcgcgtgtcttcggaactgggaccaaggtcatcgtcctggacaaaacccataccg<br>catccgaactgactcaggaccctgccgtctctgtggcactgaagcagactgtgactatt<br>acttgccgaggcgactcactgcggagccactacgcttcctggtatcagaagaaaccc<br>ggccaggcacctgtgctgctgttctacggaaagaacaataggccatctggcatcccg<br>accgcttttctggcagtgcatcagggaaccgagccagtctgaccattaccggcgccca<br>ggctgaggacgaagccgattactattgcagctcccgggataagagcggctccagact<br>gagcgtgttcggaggaggaactaaactgaccgtcctcgataagacccataccgtac<br>ggtggccgctcccagcgtgttcatcttcccacctagcgacgagcagctgaagtccgg<br>cacagcctctgtcgtgtgcctgctgaacaacttctaccccgcgaggccaaagtgcag<br>tggaaggtggacaacgcctgcagagcggcaacagccaggaaagcgtgaccgag<br>caggacagcaaggactccacctacagcctgagcagcaccctgacactgagcaaggc<br>cgactacgagaagcacaaggtgtacgcctgcgaagtgacccaccagggcctgtcta<br>gccccgtgaccaagagcttcaaccggggcgagtgt | SEQ ID<br>NO: 208 |

Binding Protein 27 Amino Acid Sequences

| | |
|---|---|
| Heavy<br>chain<br>A | ahlvqsgtamkkpgasvrvscqts*qytftahi*fwfrqapgrglewvgw*ikpqy*<br>*gav*nfgggfrdrvtltrdvyreiaymdirglkpddtavyycar*drsygdsswalda*<br>wgqgttvvvsaastkgpsvflplapsskstsggtaalgclvkdyfpepvtvswnsga<br>ltsgvhtfpavlqssglyslssvvtvpssslgtqtyicnvnhkpsntkvdkkvepksc<br>dkthtcppcpapellggpsvflfppkpkdtlmisrtpevtcvvvdvshedpevkfn<br>wyvdgvevhnaktkpreeqynstyrvvsvltvlhqdwlngkeykckvsnkalpa<br>piektiskakgqprepqvctlppsrdeltknqvslscavkgfypsdiavewesngq<br>pennykttppvldsdgsfflvskltvdksrwqqgnvfscsvlhealhshytqkslsls<br>pg | SEQ ID<br>NO: 209 |
| Light<br>chain<br>A | yihvtqspsslsvsigdrvtincqtsqgvgsdlhwyqhkpgrapkllihhtssvedg<br>vpsrfsgsgfhtsfqltisdlqaddiatyycqvlqffgrgsrlhikrtvaapsvfifppsd<br>eqlksgtasvvcllnnfypreakvqwkvdnalqsgnsqesvteqdskdstyslsstl<br>tlskadyekhkvyacevthqglsspvtksfnrgec | SEQ ID<br>NO: 210 |
| Heavy<br>chain<br>B | Evrlvesggglvkpggslrlscsasgfdfdnawmtwvrqppgkglewvg<br>ritgpgegwsvdyaesvkgrftisrdntkntlylemnnvrtedtgyyfcartg<br>kyydfwsgyppgeeyfqdwgqgtlvivssdkthtqvhltqsgpevrkpgt<br>svkvsckapgntlktydlhwvrsvpgqglqwmgwishegdkkviverfk<br>akvtidwdrstntaylqlsgltsgdtavyycakgskhrlrdyalydddgaln<br>wavdvdylsnlefwgqgtavtvssdkthtastkgpsvflplapsskstsggta<br>algclvkdyfpepvtvswnsgaltsgvhtfpavlqssglyslssvvtvpsssl<br>gtqtyicnvnhkpsntkvdkkvepkscdkthtcppcpapellggpsvflfp<br>pkpkdtlmisrtpevtcvvvdvshedpevkfnwyvdgvevhnaktkpre<br>eqynstyrvvsvltvlhqdwlngkeykckvsnkalpapiektiskakgqpr<br>epqvytlppcrdeltknqvslwclvkgfypsdiavewesngqpennykt<br>ppvldsdgsfflyskltvdksrwqqgnyfscsvlhealhshytqkslstspg | SEQ ID<br>NO: 211 |
| Light<br>chain<br>B | tdfvltqsphslsvtpgesasiscksshslihgdrnnylawyvqkpgrspqlliylassr<br>asgvpdrfsgsgsdkdftlkisrvetedvgtyycmqgrespwtfgqgtkvdikdkt<br>htaseltqdpavsvalkqtvtitcrgdskrshyaswyqkkpgqapvllfygknnrps | SEQ ID<br>NO: 212 |

TABLE 2-continued

Heavy and light chain sequences of binding proteins. CDR sequences are bolded and italicized.

gipdrfsgsasgnrasltitgaqaedeadyycssrdksgsrlsvfgggtkltvldkthtr
tvaapsvfifppsdeqlksgtasvvcllnnfypreakvqwkvdnalqsgnsqesvt
eqdskdstyslsstltlskadyekhkvyacevthqglsspvtksfnrgec Binding Protein 27 Nucleotide Sequences

| Heavy chain A | agagcccacctggtgcagtctggcaccgccatgaagaaaccaggcgcctctgtgc<br>ggggtgtcctgtcagacaagcggctacaccttcaccgcccacatcctgttctggaccg<br>gcaggcccctggcagaggactggaatgggtgggatggatcaagcccagtatggc<br>gccgtgaacttcggcggaggcttccgggatagagtgaccctgaccgggacgtgta<br>ccgcgagatcgcctacatggacatccggggcctgaagcccgatgacaccgccgtg<br>tactactgcgccagagacagaagctacggcgacagcagctgggctctggatgcttg<br>gggccagggcacaaccgtggtggtgtctgccgcctctacaaagggccccagcgtg<br>ttccctctggccctagcagcaagagcacatctggcggaacagccgccctgggctg<br>cctcgtgaaggactactttcccgagcccgtgaccgtgtcctggaattctggcgccctg<br>accagcggcgtgcacacctttccagctgtgctgcagtccagcggcctgtacagcctg<br>agcagcgtcgtgacagtgcccagcagctctctgggcacccagacctacatctgcaa<br>cgtgaaccacaagcccagcaacaccaaggtggacaagaaggtggaacccaagag<br>ctgcgacaagacccacacctgtccctttgtcctgcccccgaactgctggggaggcc<br>cttccgtgacctgacccccaaagcccaaggacaccctgatgatcagccggaccc<br>ccgaagtgacctgcgtggtggtggatgtgtcccacgaggaccctgaagtgaagttc<br>aattggtacgtggacggcgtggaagtgcacaacgccaagaccaagccaagagag<br>gaacagtacaacagcacctacccgggtggtgtccgtgctgaccgtgctgcaccagga<br>ctggctgaacggcaaagagtacaagtgcaaggtgtccaacaaggccctgcctgcc<br>cccatcgagaaaaccatcagcaaggccaagggccagccccgcgaacccccaggtg<br>tgcacactgcccccaagcagggacgagctgaccaagaaccaggtgtccctgagct<br>gtgccgtgaaaggcttctacccctccgatatcgccgtggaatgcagagcaacggc<br>cagcccgagaacaactacaagaccaccccccctgtgctggacagcgacggctcatt<br>cttcctggtgtccaagctgacagtggacaagtcccggtggcagcagggcaacgtgtt<br>cagctgctccgtgctgcacgaggccctgcacagccactacacccagaagtccctga<br>gcctgagcccggc | SEQ ID NO: 213 |
| Light chain A | tacatccacgtgacccagagccccagcagcctgtccgtgtccatcggcgacagagt<br>gaccatcaactgccagacctctcagggcgtgggcagcgacctgcactggtatcagc<br>acaagcctggcagagcccccaagctgctgatccaccacacaagcagcgtggaaga<br>tggcgtgcccagcagattaccggcagcggcttccacaccagcttccagctgaccat<br>cagcgatctgcaggccgacgacattgccacctactattgtcaggtgctgcagttcttc<br>ggcagaggcagcagactgcacatcaagcgtacggtggccgctcccagcgtgttcat<br>cttcccacctagcgacgagcagctgaagtccggcacagcctctgtcgtgtgcctgct<br>gaacaacttctaccccgcgaggccaaagtgcagtggaaggtggacaacgccctg<br>cagagcggcaacagccaggaaagcgtgaccgagcaggacagcaaggactccac<br>ctacagcctgagcagcaccctgacactgagcaaggccgactacgagaagcacaag<br>gtgtacgcctgcgaagtgacccaccagggcctgtctagccccgtgaccaagagctt<br>caaccggggcgagtgt | SEQ ID NO: 214 |
| Heavy chain B | gaggttagactggtggagtcaggagggggcttgtgaagcccggtgggtctctccg<br>cctgagctgttctgcctccggctagatttcgataacgcctggatgacctgggtcaggc<br>agcctccaggtaagggactggagtgggtgggaagaatcacaggtccaggcgagg<br>gctggtccgtgactacgcggaatctgttaaagggcggtttacaatctcaagggaca<br>ataccaagaataccttgtataggagatgaacaacgtgagaactgaagacaccggat<br>attacttctgtgccagaacaggcaaatactacgacttctggtccggctatcccctggc<br>gaggaatattacaagactggggtcagggaacccttgttatcgtgtcctccgacaaaa<br>cccatacccaggtgcacctgacacagagcggacccgaagtgcggaagcctggca<br>cctctgtgaaggtgtcctgcaaggcccctggcaacaccctgaaaacctacgacctgc<br>actgggtgcgcagcgtgccaggacagggactgcagtggatgggctggatcagcca<br>cgagggcgacaagaaagtgatcgtggaacggacaaggccaaagtgaccatcgac<br>tgggacagaagcaccaacaccgcctacctgcagctgagcggcctgacctctggcg<br>ataccgccgtgtactactgcgccaagggcagcaagcaccggctgagagactacgc<br>cctgtacgacgatgacggcgccctgaactgggccgtggatgtggactacctgagca<br>acctggaattctggggccagggcacagccgtgaccgtgtcatctgataagacccac<br>accgcttccaccaagggcccatcggtcttccccctggcaccctcctccaagagcacc<br>tctgggggcacagcggcctgggctgcctggtcaaggactacttccccgaaccggt<br>gacggtgtcgtggaactcaggcgccctgaccagcggcgtgcacaccttcccggct<br>gtcctacagtcctcaggactctactccctcagcagcgtggtgaccgtgccctccagc<br>agcttgggcacccagacctacatctgcaacgtgaatcacaagcccagcaacaccaa<br>ggtgcacaagaaagttgagcccaaatcttgtgacaaaactcacacatgcccaccgtg<br>cccagcacctgaactcctgggggaccgtcagtcttcctcttccccccaaaacccaa<br>ggacaccctcatgatctcccggacccctgaggtcacatgcgtggtggtggacgtga<br>gccacgaagaccctgaggtcaagttcaactggtatgttgacggcgtggaggtgcata<br>atgccaagacaaagccgcgggaggagcagtacaacagcacgtaccgtgtggtca<br>gcgtcctcaccgtcctgcaccaggactggctgaatggcaaggagtacaagtgcaag<br>gtctccaacaaagccctcccagcccccatcgagaaaaccatctccaaagccaaagg<br>gcagccccgagaaccacaggtgtacaccctgcccccatgccgggatgagctgacc<br>aagaatcaagtcagcctgtggtgcctggtaaaaggcttctatcccagcgacatcgcc | SEQ ID NO: 215 |

TABLE 2-continued

Heavy and light chain sequences of binding proteins. CDR sequences are bolded and italicized.

| | | |
|---|---|---|
| | gtggagtgggagagcaatgggcagccggagaacaactacaagaccacgcctccc<br>gtgctggactccgacggctccttcttcctctactcaaaactcaccgtggacaagagca<br>ggtggcagcaggggaacgtcttctcatgctccgtgctgcatgaggctctgcacagcc<br>actacacgcagaagagcctctccctgtctccgggt | |
| Light<br>chain<br>B | gacttcgtgctgacccagagccctcacagcctgagcgtgacacctggcgagagc<br>ccagcatcagctgcaagagcagccactccctgatccacggcgaccggaacaacta<br>cctggcttggtacgtgcagaagcccggcagatcccccagctgctgatctacctggc<br>cagcagagagccagcggcgtgcccgatagattactggcagcggcagcgacaag<br>gacttcaccctgaagatcagccgggtggaaaccgaggacgtgggcacctactactg<br>tatgcagggcagagagagcccctggacctttggccagggcaccaaggtggacatc<br>aaggacaaaacccataccgcatccgaactgactcaggaccctgccgtctctgtggc<br>actgaagcagactgtgactattacttgccgaggcgactcactgcggagccactacgc<br>ttcctggtatcagaagaaacccggccaggcacctgtgctgctgactacggaaagaa<br>caataggccatctggcatccccgaccgcttttctggcagtgcatcagggaaccgagc<br>cagtctgaccattaccggcgcccaggctgaggacgaagccgattactattgcagctc<br>ccgggataagagcggctccagactgagcgtgttcggaggaggaactaaactgacc<br>gtcctcgataagacccataccgtacggtggccgctcccagcgtgttcatcttcccac<br>ctagcgacgagcagctgaagtccggcacagcctctgtcgtgtgcctgctgaacaact<br>tctaccccgcgaggccaaagtgcagtggaaggtggacaacgccctgcagagcg<br>gcaacagccaggaaagcgtgaccgagcaggacagcaaggactccacctacagcc<br>tgagcagcacccctgacactgagcaaggccgactacgagaagcacaaggtgtacgc<br>ctgcgaagtgacccaccagggcctgtctagccccgtgaccaagagcttcaaccgg<br>ggcgagtgt | SEQ ID<br>NO: 216 |

Binding Protein 28 Amino Acid Sequences

| | | |
|---|---|---|
| Heavy<br>chain<br>A | Rahlvqsgtamkkpgasvrvscqtsgytftahifwfrqapgrglewvgwikpq<br>yganfgggfrdrvtltrdvyreiaymdirglkpddtavyycardrsygdsswal<br>--wgqgttvvvsaastkgpsvfplapsskstsggtaalgclvkdyfpepvtvswn<br>sgaltsgvhtfpavlqssglyslssvvtvpssslgtqtyicnvnhkpsntkvdkkve<br>pkscdkthtcppcpapellggpsvflfppkpkdtlmisrtpevtcvvvdvshedp<br>evkfnwyvdgvevhnaktkpreeqynstyrvvsvltvlhqdwlngkeykckvs<br>nkalpapiektiskakgqprepqvctlppsrdeltknqvslscavkgfypsdiave<br>wesngqpennykttppvldsdgsfflvskltvdksrwqqgnvfscsvlhealhsh<br>ytqkslslspg | SEQ ID<br>NO: 217 |
| Light<br>chain<br>A | tyihvtqspsslsvsigdrvtincqtsqgvgsdlhwyqhkpgrapkllihhtssvee<br>chaingvpsrfsgsgfhtsfqltisdlqaddiatyycqvlqffgrgsrlhikrtvaapsvfifp<br>psdeqlksgtasvvcllnnfypreakvqwkvdnalqsgnsqesvteqdskdstys<br>lsstltlskadyekhkvyacevthqglsspvtksfnrgec | SEQ ID<br>NO: 218 |
| Heavy<br>chain<br>B | Evrlvesgggslvkpggslrlscsasgfdfdnawmtwvrqppgkglewv<br>ingritgpgegwsvdyaesvkgrftisrdntkntlylemnnvrtedtgyyfca<br>rtgkyydfwsgyppgeeyfqdwgqgtlvivssdkthtqvhltqsgpevr<br>kpgtsvkvsckapgntlktydlhwvrsvpgqglqwmgwishegdkkv<br>iverfkakvtidwdrstntaylqlsgltsgdtavyycakgskhrlrdyalyd<br>ddgalnwavdvdylsnlefwgqgtavtvssdkthtastkgpsvfplapss<br>kstsggtaalgclvkdyfpepvtvswnsgaltsgvhtfpavlqssglyslss<br>vvtvpssslgtqtyicnvnhkpsntkvdkkvepkscdkthtcppcpapell<br>ggpsvflfppkpkdtlmisrtpevtcvvvdvshedpevkfnwyvdgve<br>vhnaktkpreeqynstyrvvsvltvlhqdwlngkeykckvsnkalpapie<br>ktiskakgqprepqvytlppcrdeltknqvslwclvkgfypsdiavewes<br>ngqpennykttppvldsdgsfflyskltvdksrwqqgnyfscsvlhealhs<br>hytqkslstspg | SEQ ID<br>NO: 219 |
| Light<br>chain<br>B | dfvltqsphslsvtpgesasiscksshslihgdrnnylawyvqkpgrspqlliylas<br>nsrasgvpdrfsgsgsdkdftlkisrvetedvgtyycmqgrespwtfgqgtkvdik<br>dkthtaseltqdpavsvalkqtvtitcrgdskrshyaswyqkkpgqapvllfygkn<br>nrpsgipdrfsgsasgnrasltitgaqaedeadyycssrdkqsgrlsvfgggtkltvl<br>dkthtrtvaapsvfifppsdeqlksgtasvvcllnnfypreakvqwkvdnalqsgn<br>sqesvteqdskdstyslsstltlskadyekhkvyacevthqglsspvtksfnrgec | SEQ ID<br>NO: 220 |

Binding Protein 28 Nucleotide Sequences

| | | |
|---|---|---|
| Heavy<br>chain<br>A | agagcccacctggtgcagtctggcaccgccatgaagaaaccaggcgcctctgtgc<br>ggtgtcctgtcagacaagcggctacaccttcaccgcccacatcctgttctggttccg<br>gcaggcccctggcagaggactggaatgggtgggatggatcaagcccccagtatggc<br>gccgtgaacttcggcgggaggcttccgggatagagtgaccctgacccgggacgtgta<br>ccgcgagatcgcctacatggacatccggggcctgaagcccgatgacaccgccgtg<br>tactactgcgccagagacagaagctacggcgacagcagctgggctctggatgcttg<br>gggccagggcacaaccgtggtgtgtctgccgcctctacaaaggcccccagcgtg<br>ttccctctggccccctagcagcaagagcacatctggcggaacagccgccctgggctg<br>cctcgtgaaggactactttcccgagcccgtgaccgtgtcctggaattctggcgccctg<br>accagcggcgtgcacacctttccagctgtgctgcagtccagcggcctgtacagcctg<br>agcagcgtcgtgacagtgccccagcagctctctgggcacccagacctacatctgcaa<br>cgtgaaccacaagcccagcaacaccaaggtggacaagaaggtggaacccaagag | SEQ ID<br>NO: 221 |

TABLE 2-continued

Heavy and light chain sequences of binding proteins. CDR sequences are bolded and italicized.

| | | |
|---|---|---|
| | ctgcgacaagacccacacctgtcccccttgtcctgcccccgaactgctggggaggcc<br>cttccgtgttcctgttccccccaaagcccaaggacaccctgatgatcagccggaccc<br>ccgaagtgacctgcgtggtggtggatgtgtcccacgaggaccctgaagtgaagttc<br>aattggtacgtggacggcgtggaagtgcacaacgccaagaccaagccaagagag<br>gaacagtacaacagcacctaccgggtggtgtccgtgctgaccgtgctgcaccagga<br>ctggctgaacggcaaagagtacaagtgcaaggtgtccaacaaggccctgcctgcc<br>cccatcgagaaaaccatcagcaaggccaagggccagccccgcgaacccccaggtg<br>tgcacactgcccccaagcagggacgagctgaccaagaaccaggtgtccctgagct<br>gtgccgtgaaaggcttctacccctccgatatcgccgtggaatgggagagcaacggc<br>cagcccgagaacaactacaagacccaccccccctgtgctggacagcgacggctcatt<br>cttcctggtgtccaagctgacagtggacaagtcccggtggcagcagggcaacgtgtt<br>cagctgctccgtgctgcacgaggccctgcacagccactacacccagaagtccctga<br>gcctgagccccggc | |
| Light<br>chain<br>A | tacatccacgtgacccagagccccagcagcctgtccgtgtccatcggcgacagagt<br>gaccatcaactgccagacctctcagggcgtgggcagcgacctgcactggtatcagc<br>acaagcctggcagagccccaagctgctgatccaccacacaagcagcgtggaaga<br>aggcgtgcccagcagattttccggcagcggcttccacaccagcttcaacctgaccat<br>cagcgatctgcaggccgacgacattgccacctactattgtcaggtgctgcagttcttc<br>ggcagaggcagcagactgcacatcaagcgtacggtggccgctcccagcgtgttcat<br>cttcccacctagcgacgagcagctgaagtccggcacagcctctgtcgtgtgcctgct<br>gaacaacttctaccccgcgaggcaaagtgcagtggaaggtggacaacgccctg<br>cagagcggcaacagccaggaaaagcgtgaccgagcaggacagcaaggactccac<br>ctacagcctgagcagcaccctgacactgagcaaggccgactacgagaagcacaag<br>gtgtacgcctgcgaagtgacccaccagggcctgtctagccccgtgaccaagagctt<br>caaccggggcgagtgt | SEQ ID<br>NO: 222 |
| Heavy<br>chain<br>B | gaggttagactggtggagtcaggaggggggcttgtgaagcccggtgggtctctccg<br>cctgagctgttctgcctccggctttgatttcgataacgcctggatgacctgggtcaggc<br>agcctccaggtaagggactggagtgggtgggaagaatcacaggtccaggcgagg<br>gctggtccgtggactacgcggaatctgttaaagggcggtttacaatctcaagggaca<br>ataccaagaataccttgtatttggagatgaacaacgtgagaagctgaagacaccggat<br>attacttctgtgccagaacaggcaaatactacgacttctggtccggctatcccctggc<br>gaggaatattttcaagactggggtcagggaaccccttgttatcgtgtcctccgacaaaa<br>cccatacccaggtgcacctgacacagagcggaccgaagtgcggaagcctggca<br>cctctgtgaaggtgtcctgcaaggcccctggcaacacccgtgaaaacctacgacctgc<br>actgggtgcgcagcgtgccaggacagggactgcagtggatgggctggatcagcca<br>cgagggcgacaagaaagtgatcgtggaacggttcaaggccaaagtgaccatcgac<br>tgggacagaagcaccaacaccgcctacctgcagctgagcggcctgacctctggcg<br>ataccgccgtgtactactgcgccaagggcagcaagcaccggctgagagactacgc<br>cctgtacgacgatgacggcgccctgaactgggccgtggatgtggactacctgagca<br>acctggaattctggggccagggcacagccgtgaccgtgtcatctgataagacccac<br>accgcttccaccaagggcccatcggtcttccccctggcaccctcctccaagagcacc<br>tctgggggcacagcggccctgggctgcctggtcaaggactacttccccgaaccggt<br>gacggtgtcgtggaactcaggcgccctgaccagcggcgtgcacaccttcccggct<br>gtcctacagtcctcaggactctactccctcagcagcgtggtgaccgtgccctccagc<br>agcttgggcacccagacctacatctgcaacgtgaatcacaagcccagcaacaccaa<br>ggtggacaagaaagttgagcccaaatcttgtgacaaaactcacacatgccaccgtg<br>cccagcacctgaactcctgggggaccgtcagtcttcctcttccccccaaaacccaa<br>ggacaccctcatgatctcccggacccctgaggtcacatgcgtggtggtggacgtga<br>gccacgaagaccctgaggtcaagttcaactggtatgttgacggcgtggaggtgcata<br>atgccaagacaaagccgcgggaggagcagtacaacagcacgtaccgtgtggtca<br>gcgtcctcaccgtcctgcaccaggactggctgaatggcaaggagtacaagtgcaag<br>gtctccaacaaagcccttcccagcccccatcgagaaaaccatctccaaagccaaagg<br>gcagccccgagaaccacaggtgtacaccctgcccccatgcgggatgagctgacc<br>aagaatcaagtcagcctgtggtgcctggtaaaaggcttctatcccagcgacatcgcc<br>gtggagtgggagagcaatgggcagccggagaacaactacaagaccacgcctccc<br>gtgctggactccgacggctccttcttcctctactcaaaactcaccgtggacaagagca<br>ggtggcagcaggggaacgtcttctcatgctccgtgctgcatgaggctctgcacagcc<br>actacacgcagaagagcctctccctgtctccgggt | SEQ ID<br>NO: 223 |
| Light<br>chain<br>B | gacttcgtgctgacccagagccctcacagcctgagcgtgacacctggcgagagcg<br>cccagcatcagctgcaagagcagccactccctgatccacggcgaccggaacaacta<br>cctggcttggtacgtgcagaagcccggcagatcccccaagctgctgatctacctggc<br>cagcagcagagccagcggcgtgcccgatagattttctggcagcggcagcgacaag<br>gacttcaccctgaagatcagccgggtggaaaccgaggacgtgggcacctactactg<br>tatgcagggcagagagagccctgaccctaggccagggcaccaaggtggacatc<br>aaggacaaaacccataccgcatccgaactgactcaggaccctgccgtgtctctgtggc<br>actgaagcagactgtgactattacttgccgaggcgactcactgcggagccactacgc<br>ttcctggtatcagaagaaacccggccaggcacctgtgctgctgttctacggaaagaa<br>caataggccatctggcatcccgaccgcttactggcagtgcatcagggaaccgagc<br>cagtctgaccattaccggcgccaggctgaggacgaagccgattactattgcagctc<br>ccgggataagagcggctccagactgagcgtgttcggaggaggaactaaactgacc<br>gtcctcgataagacccataccgtacggtggccgctcccagcgtgacatcttcccac<br>ctagcgacgagcagctgaagtccggcacagcctctgtcgtgtgcctgctgaacaact<br>tctaccccgcgaggccaaagtgcagtggaaggtggacaacgccctgcagagcg<br>gcaacagccaggaaagcgtgaccgagcaggacagcaaggactccacctacagcc | SEQ ID<br>NO: 224 |

TABLE 2-continued

Heavy and light chain sequences of binding proteins. CDR sequences are bolded and italicized.

```
tgagcagcaccctgacactgagcaaggccgactacgagaagcacaaggtgtacgc
ctgcgaagtgacccaccagggcctgtctagccccgtgaccaagagcttcaaccgg
ggcgagtgt
```

Binding Protein 29 Amino Acid Sequences

| | | |
|---|---|---|
| Heavy chain A | Rahlvqsgtamkkpgasvrvscqts*gytftahi*fwfrqapgrglewvgw*ikpq ygan*fgggfrdrvtltrdvyreiaymdirglkpddtavyycard*rsygdsswal da*wgqgttvvvsaastkgpsvfplapssкstsggtaalgclvkdyfpepvtvswn sgaltsgvhtfpavlqssglyslssvvtvpssslgtqtyicnvnhkpsntkvdkkve pkscdkthtcppcpapellggpsvflfppkpkdtlmisrtpevtcvvvdvshedp evkfnwyvdgvevhnaktkpreeqynstyrvvsvltvlhqdwlngkeykckvs nkalpapiektiskakgqprepqvctlppsrdeltknqvslscavkgfypsdiave wesngqpennykttppvldsdgsfflvskltvdksrwqqgnvfscsvlhealhsh ytqkslslspg | SEQ ID NO: 225 |
| Light chain A | tyihvtqspsslsvsigdrvtincqtsqgvgsdlhwyqhkpgrapkllihhtssved navpsrfsgsgfhtsfnltisdlqaddiatyycqvlqffgrgsrlhikrtvaapsvfifpp sdeqlksgtasvvcllnnfypreakvqwkvdnalqsgnsqesvteqdskdstysl sstltlskadyekhkvyacevthqglsspvtksfnrgec | SEQ ID NO: 226 |
| Heavy chain B | Evrlvesggglvkpggslrlscsasgfdfdnawmtwvrqppgkglewv gritgpgegwsvdyaesvkgrftisrdntkntlylemnnvrtedtgyyfca rtgkyydfwsgyppgeeyfqdwgqgtlvivssdkthtqvhltqsgpevr kpgtsvkvsckapgntlktydlhwvrsvpgqglqwmgwishegdkkv iverfkakvtidwdrstntaylqlsgltsgdtavyycakgskhrlrdyalyd ddgalnwavdvdylsnlefwgqgtavtvssdkthtastkgpsvfplapss kstsggtaalgclvkdyfpepvtvswnsgaltsgvhtfpavlqssglyslss vvtvpssslgtqtyicnvnhkpsntkvdkkvepkscdkthtcppcpapell ggpsvflfppkpkdtlmisrtpevtcvvvdvshedpevkfnwyvdgve vhnaktkpreeqynstyrvvsvltvlhqdwlngkeykckvsnkalpapie ktiskakgqprepqvytlppcrdeltknqvslwclvkgfypsdiavewes ngqpennykttppvldsdgsfflyskltvdksrwqqgnyfscsvlhealhs hytqkslstspg | SEQ ID NO: 227 |
| Light chain B | dfvltqsphslsvtpgesasisckssнslihgdrnnylawyvqkpgrspqlliylas srasgvpdrfsgsgsdkdftlkisrvetedvgtyycmqgrespwtfgqgtkvdik dkthtaseltqdpavsvalkqtvtitcrgdskrshyaswyqkkpgqapvllfygkn nrpsgipdrfsgsasgnrasltitgaqaedeadyycssrdksgsrlsvfgggtkltvl dkthtrtvaapsvfifppsdeqlksgtasvvcllnnfypreakvqwkvdnalqsgn sqesvteqdskdstyslsstltlskadyekhkvyacevthqglsspvtksfnrgec | SEQ ID NO: 228 |

Binding Protein 29 Nucleotide Sequences

| | | |
|---|---|---|
| Heavy chain A | agagcccacctggtgcagtctggcaccgccatgaagaaaccaggcgcctctgtgc ggtgtcctgtcagacaagcggctacaccttcaccgcccacatcctgttctggttccg gcaggcccctggcagaggactggaatgggtgggatggatcaagcccccagtatggc gccgtgaacttcggcggaggcttccgggatagagtgaccctgacccgggacgtga ccgcgagatcgcctacatggacatccgggggcctgaagcccgatgacaccgccgtg tactactgcgccagagacagaagctacggcgacagcagctgggctctggatgcttg gggccagggcacaaccgtggtggtgtctgccgcctctacaaagggcccccagcgtg ttccctctggccctagcagcaagagcacatctggcggaacgccgcctgggctg cctcgtgaaggactactttcccgagcccgtgaccgtgtcctggaattctggcgccctg accagcggcgtgcacacctttccagctgtgctgcagtccagcggcctgtacagcctg agcagcgtcgtgacagtgcccagcagctctctgggcacccagacctacatctgcaa cgtgaaccacaagcccagcaacaccaaggtggacaagaaggtggaaccaagag ctgcgacaagacccacacctgtcccccttgtcctgccccgaactgctgggaggcc cttccgtgttcctgttccccccaaagcccaaggacaccctgatgatcagccggaccc ccgaagtgacctgcgtggtggtggatgtgtcccacgaggaccctgaagtgaagtca attggtacgtggacggcgtggaagtgcacaacgccaagaccaagccaagagagg aacagtacaacagcacctaccggggtggtgtccgtgctgaccgtgctgcaccaggac tggctgaacggcaaagagtacaagtgcaaggtgtccaacaaggcctgcctgcccc catcgagaaaaccatcagcaaggccaagggccagccccgcgaacccaggtgtg cacactgccccccaagcaggggacgagctgaccaagaaccaggtgtcctgagctgt gccgtgaaaggcttctaccccctccgatatcgccgtggaatgggagagcaacggcca gcccgagaacaactacaagaccacccccctgtgctggacagcgacggctcattct tcctggtgtccaagctgacagtggacaagtcccggtggcagcagggcaacgtgttc agctgctccgtgctgcacgaggccctgcacagccactacacccagaagtccctgag cctgagccccggc | SEQ ID NO: 229 |
| Light chain A | tacatccacgtgacccagagccccagcagcctgtccgtgtccatcggcgacagagt gaccatcaactgccagacctctcagggcgtgggcagcgacctgcactggtatcagc acaagctggccgagccccaagctgcatccaccacaagcagctggaaga tgccgtgcccagcagattttccggcagcggcttccacaccagcttcaacctgaccatc agcgatctgcaggccgacgacattgccacctactattgtcaggtgctgcagttcttcg gcagaggcagcagactgcacatcaagcgtacggtggccgctcccagcgtgttcatc ttcccacctagcgacgagcagctgaagtccggcacagcctctgtcgtgtgcctgctg | SEQ ID NO: 230 |

TABLE 2-continued

Heavy and light chain sequences of binding proteins. CDR sequences are bolded and italicized.

| | | |
|---|---|---|
| | aacaacttctaccccgcgaggccaaagtgcagtggaaggtggacaacgccctgc agagcggcaacagccaggaaagcgtgaccgagcaggacagcaaggactccacct acagcctgagcagcaccctgacactgagcaaggccgactacgagaagcacaaggt gtacgcctgcgaagtgacccaccagggcctgtctagccccgtgaccaagagcttca accggggcgagtgt | |
| Heavy chain B | gaggttagactggtggagtcaggaggggggcttgtgaagcccggtgggtctctccg cctgagctgttctgcctccggctttgatttcgataacgcctggatgacctgggtcaggc agcctccaggtaagggactggagtgggtgggaagaatcacaggtccaggcgagg gctggtccgtggactacgcggaatctgttaaagggcggtttacaatctcaagggaca ataccaagaataccttgtataggagatgaacaacgtgagaactgaagacaccggat attacttctgtgccagaacaggcaaatactacgacttctggtccggctatccccctggc gaggaatattacaagactgggtcagggaacccttgttatcgtgtcctccgacaaaa cccatacccaggtgcacctgacacagagcggacccgaagtgcggaagcctggca cctctgtgaaggtgtcctgcaaggcccctggcaacacccctgaaaacctacgacctgc actgggtgcgcagcgtgccaggacagggactgcagtggatgggctggatcagcca cgagggcgacaagaaagtgatcgtggaacggttcaaggcaaagtgaccatcgac tgggacagaagcaccaacaccgcctacctgcagctgagcggcctgacctctggcg ataccgccgtgtactactgcgccaagggcagcaagcaccggctgagagactacgc cctgtacgacgatgacggcgccctgaactgggccgtggatgtggactacctgagca acctggaattctggggccagggcacagccgtgaccgtgtcatctgataagacccac accgcttccaccaagggcccatcggtcttcccctggcacctcctccaagagcacc tctgggggcacagcgccctgggctgccggtcaaggactacttccccgaaccggt gacggtgtcgtggaactcaggcgccctgaccagcggcgtgcacaccttcccggctg tcctacagtcctcaggactctactccctcagcagcgtggtgaccgtgccctccagca gcttgggcacccagacctacatctgcaacgtgaatcacaagcccagcaacaccaag gtggacaagaaagttgagcccaaatcttgtgacaaaactcacacatgcccaccgtgc ccagcacctgaactcctggggggaccgtcagtcttcctcttccccccaaaacccaag gacacccctcatgatctcccggacccctgaggtcacatgcgtggtggtggacgtgag ccacgaagaccctgaggtcaagttcaactggtatgttgacggcgtggaggtgcataa tgccaagacaaagccgcgggaggagcagtacaacagcacgtaccgtgtggtcagc gtcctcaccgtcctgcaccaggactggctgaatggcaaggagtacaagtgcaaggt ctccaacaaagcctcccagccccatcgagaaaaccatctccaaagccaaaggg cagccccgagaaccacaggtgtacaccctgccccatgccgggatgagctgacca agaatcaagtcagcctgtggtgcctggtaaaaggcttctatcccagcgacatcgccgt gggagtgggagagcaatgggcagccggagaacaactacaagaccacgcctcccgt gctggactccgacggctccttcttcctctactcaaaactcaccgtggacaagagcag gtggcagcagggaacgtcttctcatgctccgtgctgcatgaggctctgcacagcca ctacacgcagaagagcctctccctgtctccgggt | SEQ ID NO: 231 |
| Light chain B | tgacttcgtgctgacccagagccctcacagcctgagcgtgacacctggcgagagcg ccagcatcagctgcaagagcagccactccctgatccacggcgaccggaacaacta cctggcttggtacgtgcagaagcccggcagatccccccagctgctgatctacctggc cagcagcagagccagcggcgtgcccgatagattttctggcagcggcagcgacaag gacttcacccctgaagatcagccgggtggaaaccgaggacgtgggcacctactactg tatgcagggcagagagagcccctggacctaggccagggcaccaaggtggacatc aaggacaaaacccataccgcatccgaactgactcaggaccctgccgtctctgtggc actgaagcagactgtgactattacttgccgaggcgactcactgcggagccactacgc ttcctggtatcagaagaaacccggccaggcacctgtgctgctgttctacggaaagaa caataggccatctggcatccccgaccgcttactggcagtgcatcagggaaccgagc cagtctgaccattaccggcgcccaggctgaggacgaagccgattactattgcagctc ccgggataagagcggctccagactgagcgtgttcggaggaggaactaaactgacc gtcctcgataagacccataccgtacggtggccgctcccagcgtgacatcttcccac ctagcgacgagcagctgaagtccggcacagcctctgtcgtgtgcctgctgaacaact tctaccccgcgaggccaaagtgcagtggaaggtggacaacgccctgcagagcg gcaacaggaaagcgtgaccgagcaggacagcaaggactccacctacagcc tgagcagcaccctgacactgagcaaggccgactacgagaagcacaaggtgtacgc ctgcgaagtgacccaccagggcctgtctagccccgtgaccaagagcttcaaccggg gcgagtgt | SEQ ID NO: 301 |
| | Binding Protein 30 Amino Acid Sequences | |
| Heavy chain A | Rahlvqsgtamkkpgasvrvscqtsgytftahifwfrqapgrglewvgwikpq yganfgggfrdrvtltrdvyreiaymdirglkpddtavyycardrsygdsswald awgqgttvvvsaastkgpsvfplapssksstsggtaalgclvkdyfpepvtvswns galtsgvhtfpavlqssglyslssvvtvpssslgtqtyicnvnhkpsntkvdkkvep kscdkthtcppcpapellggpsvflfppkpkdtlmisrtpevtcvvvdvshedpe vkfnwyvdgvevhnaktkpreeqynstyrvvsvltvlhqdwlngkeykckvsn kalpapiektiskakgqprepqvctlppsrdeltknqvslscavkgfypsdiavew esngqpennykttppvldsdgsfflvskltvdksrwqqgnvfscsvlhealhshyt qkslslspg | SEQ ID NO: 232 |
| Light chain A | tyihvtqspsslsvsigdrvtincqtsqgvgsdlhwyqhkpgrapkllihhtssvee ngvpsrfsgsgfhtsfqltisdlqaddiatyycqvlqffgrgsrlhikrtvaapsvfifp psdeqlksgtasvvcllnnfypreakvqwkvdnalqsgnsqesvteqdskdstys lsstltlskadyekhkvyacevthqglsspvtksfnrgec | SEQ ID NO: 233 |

TABLE 2-continued

Heavy and light chain sequences of binding proteins. CDR sequences are bolded and italicized.

| | | |
|---|---|---|
| Heavy chain B | Evrlvesgggglvkpggslrlscsasgfdfdnawmtwvrqppgkglewv gritgpgegwsvdyaesvkgrftisrdntkntlylemnnvrtedtgyyfca rtgkyydfwsgyppgeeyfqdwgqgtlvivssdkthtqvhltqsgpevr kpgtsvkvsckapgntlktydlhwvrsvpgqglqwmgwishegdkkv iverfkakvtidwdrstntaylqlsgltsgdtavyycakgskhrlrdyalyd ddgalnwavdvdylsnlefwgqgtavtvssdkthtastkgpsvfplapss kstsggtaalgclvkdyfpepvtvswnsgaltsgvhtfpavlqssglyslss vvtvpssslgtqtyicnvnhkpsntkvdkkvepkscdkthtcppcpapell ggpsvflfppkpkdtlmisrtpevtcvvvdvshedpevkfnwyvdgve vhnaktkpreeqynstyrvvsvltvlhqdwlngkeykckvsnkalpapie ktiskakgqprepqvytlppcrdeltknqvslwclvkgfypsdiavewes ngqpennykttppvldsdgsfflyskltvdksrwqqgnyfscsvlhealhs hytqkslstspg | SEQ ID NO: 234 |
| Light chain B | dfvltqsphslsvtpgesasiscksshslihgdrnnylawyvqkpgrspqlliylas srasgvpdrfsgsgsdkdftlkisrvetedvgtyycmqgrespwtfgqgtkvdik dkthtaseltqdpavsvalkqtvtitcrgdskrshyaswyqkkpgqapvllfygkn nrpsgipdrfsgsasgnrasltitgaqaedeadyycssrdksgsrlsvfgggtkltvl dkthtrtvaapsvfifppsdeqlksgtasvvcllnnfypreakvqwkvdnalqsgn sqesvteqdskdstyslsstltlskadyekhkvyacevthqglsspvtksfnrgec | SEQ ID NO: 235 |

Binding Protein 30 Nucleotide Sequences

| | | |
|---|---|---|
| Heavy chain A | agagcccacctggtgcagtctggcaccgccatgaagaaaccaggcgcctctgtgc ggtgtcctgtcagacaagcggctacaccttcaccgcccacatcctgactggttccg gcaggcccctggcagaggactggaatgggtgggatggatcaagcccccagtatggc gccgtgaacttcggcggaggcttccgggatagagtgaccctgacccgggacgtgta ccgcgagatcgcctacatggacatccgggccctgaagcccgatgacaccgccgtg tactactgcgccagagacagaagctacggcgacagcagctgggctctggatgcttg gggccagggcacaaccgtggtggtgtctgccgcctctacaaagggccccagcgtg ttccctctggcccctagcagcaagagcacatctggcggaacagccgccctgggctg cctcgtgaaggactactttcccgagcccgtgaccgtgtcctggaattctggcgccctg accagcggcgtgcacaccttccagctgtgctgcagtccagcggcctgtacagcctg agcagcgtcgtgacagtgcccagcagctctctgggcacccagacctacatctgcaa cgtgaaccacaagcccagcaacaccaaggtggacaagaaggtggaacccaagag ctgcgacaagacccacacctgtccccttgtcctgccccgaactgctgggaggcc cttccgtgttcctgttccccccaaagcccaaggacacccctgatgatcagccggaccc ccgaagtgacctgcgtggtggtggatgtgtcccacgaggaccctgaagtgaagttca attggtacgtggacggcgtggaagtgcacaacgccaagaccaagccaagagagg aacagtacaacagcacctaccgggtggtgtccgtgctgaccgtgctgcaccaggac tggctgaacggcaaagagtacaagtgcaaggtgtccaacaagccctgcctgcccc catcgagaaaaccatcagcaaggccaagggccagccccgcgaacccaggtgtg cacactgcccccaagcagggacgagctgaccaagaaccaggtgtccctgagctgt gccgtgaaaggcttctacccctcgatatcgccgtgaatgggagagcaacggcca gcccgagaacaactacaagaccacccccctgtgctggacagcgacggctcattct tcctggtgtccaagctgacagtggacaagtcccgtggcagcagggcaacgtgac agctgctccgtgctgcacgaggccctgcacagccactacacccagaagtccctgag cctgagccccggc | SEQ ID NO: 236 |
| Light chain A | ttacatccacgtgacccagagccccagcagcctgtccgtgtccatcggcgacagagt gaccatcaactgccagacctctcagggcgtgggccagcgacctgcactggtatcagc acaagcctggcagagcccccaagctgctgatccaccacacaagcagcgtggaaga aggcgtgcccagcagattaccggcagcggcttccacaccagcttccagctgaccat cagcgatctgcaggccgacgacattgccacctactattgtcaggtgctgcagttcttc ggcagaggcagcagactgcacatcaagcgtacggtggccgctcccagcgtgttcat cttcccacctagcgacgagcagctgaagtccggcacagcctctgtcgtgtgcctgct gaacaacttctaccccgcgaggccaaagtcagtggaaggtggacaacgccctg cagagcggcaacagccaggaaagcgtgaccgagcaggacagcaaggactccac ctacagcctgagcagcaccctgacactgagcaaggccgactacgagaagcacaag gtgtacgcctgcgaagtgacccaccagggcctgtctagccccgtgaccaagagctt caaccggggcgagtgt | SEQ ID NO: 237 |
| Heavy chain B | gaggttagactggtggagtcaggaggggggcttgtgaagcccgtggtctctccg cctgagctgactgcctccggctagatttcgataacgcctgatgacctggtcaggc agcctccaggtaagggactggagtgggtgggaagaatcacaggtccaggcgagg gctggtccgtggactacgcggaatctgttaaagggcggtttacaatctcaagggaca ataccaagaataccttgtataggagatgaacaacgtgagaactgaagacaccggat attacttctgtgccagaacaggcaaatactacgacttctggtccggctatcccccctggc gaggaatattacaagactggggtcagggaaccccttgttatcgtgtcctccgacaaa ccccatacccaggtcacctgacacagagcggacccgaagtcgcggaagcctggca cctctgtgaaggtgtcctgcaaggcccctggcaacaccctgaaaacctacgacctgc actgggtgcgcagcgtgccaggacagggactgcagtggatgggctggatcagcca cgagggcgacaagaaagtgatcgtggaacggttcaaggccaaagtgaccatcgac tgggacagaagcaccaacaccgcctacctgcagctgagcggcctgacctctggcg ataccgccgtgtactactgcgccaagggcagcaagcaccggctgagagactacgc cctgtacgacgatgacggcgccctgaactgggccgtggatgtggactacctgagca acctggaattctggggccagggcacagccgtgaccgtgtcatctgataagacccac | SEQ ID NO: 238 |

TABLE 2-continued

Heavy and light chain sequences of binding proteins. CDR sequences are bolded and italicized.

| | | |
|---|---|---|
| | accgcttccaccaagggcccatcggtcttccccctggcaccctcctccaagagcacc<br>tctgggggcacagcggccctgggctgcctggtcaaggactacttccccgaaccggt<br>gacggtgtcgtggaactcaggcgccctgaccagcggcgtgcacaccttcccggctg<br>tcctacagtcctcaggactctactccctcagcagcgtggtgaccgtgccctccagca<br>gcttgggcacccagacctacatctgcaacgtgaatcacaagcccagcaacaccaag<br>gtggacaagaaagttgagcccaaatcttgtgacaaaactcacacatgcccaccgtgc<br>ccagcacctgaactcctggggggaccgtcagtcttcctcttccccccaaaacccaag<br>gacaccctcatgatctcccggacccctgaggtcacatgcgtggtggtggacgtgag<br>ccacgaagaccctgaggtcaagttcaactggtatgttgacggcgtggaggtgcataa<br>tgccaagacaaagccgcgggaggagcagtacaacagcacgtaccgtgtggtcagc<br>gtcctcaccgtcctgcaccaggactggctgaatggcaaggagtacaagtgcaaggt<br>ctccaacaaagcccccagccccatcgagaaaaccatctccaaagccaaaggg<br>cagccccgagaaccacaggtgtacaccctgccccatgccgggatgagctgacca<br>agaatcaagtcagcctgtggtgcctggtaaaaggcttctatcccagcgacatcgccgt<br>ggagtgggagagcaatgggcagccggagaacaactacaagaccacgcctcccgt<br>gctggactccgacggctccttcttcctctactcaaaactcaccgtggacaagagcag<br>gtggcagcaggggaacgtcttctcatgctccgtgctgcatgaggctctgcacagcca<br>ctacacgcagaagagcctctccctgtctccgggt | |
| Light<br>chain<br>B | Gacttcgtgctgacccagagccctcacagcctgagcgtgacacctggcgagagcg<br>ccagcatcagctgcaagagcagccactccctgatccacggcgaccggaacaacta<br>cctggcttggtacgtgcagaagcccggcagatccccccagctgctgatctacctggc<br>cagcagcagagccagcggcgtgcccgatagattactggcagcgcagcgacaag<br>gacttcaccctgaagatcagccgggtggaaaccgaggacgtgggcacctactactg<br>tatgcagggcagagagagcccctggacctttggccagggcaccaaggtggacatc<br>aaggacaaaacccataccgcatccgaactgactcaggaccctgccgtctctgtggc<br>actgaagcagactgtgactattacttgccgaggcgactcactgcggagccactacgc<br>ttcctggtatcagaagaaacccggccaggcacctgtgctgctgttctacggaaagaa<br>caataggccatctggcatccccgaccgcttactggcagtgcatcagggaaccgagc<br>cagtctgaccattaccggcgcccaggctgaggacgaagccgattactattgcagctc<br>ccgggataagagcggctccagactgagcgtgttcggaggaggaactaaactgacc<br>gtcctcgataagacccataccgtacggtggccgctcccagcgtgacatcttcccac<br>ctagcgacgagcagctgaagtccggcacagcctctgtcgtgtgcctgctgaacaact<br>tctaccccgcgaggccaaagtgcagtggaaggtggacaacgccctgcagagcg<br>gcaacagcaggaaagcgtgaccgagcaggacagcaaggactccacctacagcc<br>tgagcagcaccctgacactgagcaaggccgactacgagaagcacaaggtgtacgc<br>ctgcgaagtgacccaccagggcctgtctagccccgtgaccaagagcttcaaccggg<br>gcgagtgt | SEQ ID<br>NO: 239 |

Binding Protein 31 Amino Acid Sequences

| | | |
|---|---|---|
| Heavy<br>chain<br>A | Rahlvqsgtamkkpgasvrvscqts*gytftahi*fwfrqapgrglewvgw*ikpq*<br>*yga*nfgggfrdrvtltrdvyreiaymdirglkpddtavyycar*drsygdsswald*<br>*a*wgqgttvvvsaastkgpsvfplapssksstsggtaalgclvkdyfpepvtvswns<br>galtsgvhtfpavlqssglyslssvvtvpssslgtqtyicnvnhkpsntkvdkkvep<br>kscdkthtcppcpapellggpsvflfppkpkdtlmisrtpevtcvvvdvshedpe<br>vkfnwyvdgvevhnakttkpreeqynstyrvvsvltvlhqdwlngkeykckvsn<br>kalpapiektiskakgqprepqvctlppsrdeltknqvslscavkgfypsdiavew<br>esngqpennykttppvldsdgsfflvskltvdksrwqqgnvfscsvlhealhshyt<br>qkslslspg | SEQ ID<br>NO: 240 |
| Light<br>chain<br>A | Yihvtqspsslsvsigdrvtincqtsqgvgsdlhwyqhkpgrapkllihhtssved<br>avpsrfsgsgsgfhtsfqltisdlqaddiatyycqvlqffgrgsrlhikrtvaapsvfifpp<br>sdeqlksgtasvvcllnnfypreakvqwkvdnalqsgnsqesvteqdskdstysl<br>sstltlskadyekhkvyacevthqglsspvtksfnrgec | SEQ ID<br>NO: 241 |
| Heavy<br>chain<br>B | Evrlvesggglvkpggslrlscsasgfdfdnawmtwvrqppgkglewv<br>grgitgpgegwsvdyaesvkgrftisrdntkntlylemnnvrtedtgyyfcar<br>tgkyydfwsgyppgeeyfqdwgqgtlvivssdkthtqvhltqsgpevrk<br>pgtsvkvsckapgntlktydlhwvrsvpgqglqwmgwishegdkkviv<br>erfkakvtidwdrstntaylqlsgltsgdtavyycakgskhrlrdyalyddd<br>galnwavdvdylsnlefwgqgtavtvssdkthtastkgpsvfplapssksT<br>sggtaalgclvkdyfpepvtvswnsgaltsgvhtfpavlqssglyslssvvt<br>vpssslgtqtyicnvnhkpsntkvdkkvepkscdkthtcppcpapellgg<br>psvflfppkpkdtlmisrtpevtcvvvdvshedpevkfnwyvdgvevhn<br>aktkpreeqynstyrvvsvltvlhqdwlngkeykckvsnkalpapiektis<br>kakggqprepqvytlppcrdeltknqvslwclvkgfypsdiavewesngq<br>pennykttppvldsdgsfflyskltvdksrwqqgnyfscsvlhealhshyt<br>qkslstspg | SEQ ID<br>NO: 242 |
| Light<br>chain<br>B | dfvltqsphslsvtpgesasiscksshslihgdrnnylawyvqkpgrspqlliylass<br>rasgvpdrfsgsgsdkdftlkisrvetedvgtyycmqgrespwtfgqgtkvdikd<br>kthtaseltqdpavsvalkqtvtitcrgdslrshyaswyqkkpgqapvllfygknnr<br>psgipdrfsgsasgnrasltitgaqaedeadyycssrdksgsrlsvfgggtkltvldk<br>thtrtvaapsvfifppsedqlksgtasvvcllnnfypreakvqwkvdnalqsgnsq<br>esvteqdskdstyslsstltlskadyekhkvyacevthqglsspvtksfnrgec | SEQ ID<br>NO: 243 |

TABLE 2-continued

Heavy and light chain sequences of binding proteins. CDR sequences are bolded and italicized.

Binding Protein 31 Nucleotide Sequences

| | | |
|---|---|---|
| Heavy chain A | agagcccacctggtgcagtctggcaccgccatgaagaaaccaggcgcctctgtgc ggggtgtcctgtcagacaagcggctacaccttcaccgcccacatcctgactggaccg gcaggcccctggcagaggactggaatgggtgggatggatcaagcccagtatggc gccgtgaacttcggcggaggcttccgggatagagtgaccctgaccgggacgtgta ccgcgagatcgcctacatggacatccggggcctgaagcccgatgacaccgccgtg tactactgcgccagagacagaagctacggcgacagcagctgggctctggatgcttg gggccagggcacaaccgtggtggtgtctgccgcctctacaaagggccccagcgtg ttccctctggccctagcagcaagagcacatctggcggaacagccgccctgggctg cctcgtgaaggactactttcccgagcccgtgaccgtgtcctggaattctggcgccctg accagcggcgtgcacacctttccagctgtgctgcagtccagcggcctgtacagcctg agcagcgtcgtgacagtgcccagcagctctctgggcacccagacctacatctgcaa cgtgaaccacaagcccagcaacaccaaggtggacaagaaggtggaacccaagag ctgcgacaagacccacacctgtccccttgtcctgccccgaactgctggggaggcc cttccgtgttcctgttcccccaaagcccaaggacaccctgatgatcagccggaccc ccgaagtgacctgcgtggtggtggatgtgtcccacgaggaccctgaagtgaagttc aattggtacgtggacggcgtggaagtgcacaacgccaagacccaagccaagagag gaacagtacaacagcacctaccgggtggtgtccgtgctgaccgtgctgcaccagga ctggctgaacggcaaagagtacaagtgcaaggtgtccaacaaggccctgcctgcc cccatcgagaaaaccatcagcaaggccaagggccagccccgcgaaccccaggtg tgcacactgccccaagcagggacgagctgaccaagaaccaggtgtccctgagct gtgccgtgaaaggcttctaccccctccgatatcgccgtggaatgggagagcaacggc cagcccgagaacaactacaagaccacccccctgtgctggacagcgacggctcatt cttcctggtgtccaagctgacagtggacaagtcccggtggcagcagggcaacgtgtt cagctgctccgtgctgcacgaggccctgcacagccactacacccagaagtccctga gcctgagcccccggc | SEQ ID NO: 244 |
| Light chain A | ttacatccacgtgacccagagccccagcagcctgtccgtgtccatcggcgacagagt gaccatcaactgccagacctctcagggcgtgggcagcgacctgcactggtatcagc acaagcctggcagagcccaagctgctgatccaccacaagcagcgtggaaga tgccgtgcccagcagattttccggcagcggcttccacaccagcttccagctgaccat cagcgatctgcaggccgacgacattgccacctactattgtcaggtgctgcagttcttc ggcagaggcagcagactgcacatcaagcgtacggtggccgctcccagcgtgttcat cttcccaccctagcgacgagcagctgaagtccggcacagcctctgtcgtgtgcctgct gaacaacttctaccccgcgaggccaaagtgcagtggaaggtggacaacgccctg cagagcggcaacagccaggaaagcgtgaccgagcaggacagcaaggactccac ctacagcctgagcagcaccctgacactgagcaaggccgactacgagaagcacaag gtgtacgcctgcgaagtgacccaccagggcctgtctagccccgtgaccaagagctt caaccggggcgagtgt | SEQ ID NO: 245 |
| Heavy chain B | gaggttagactggtggagtcaggaggggggcttgtgaagcccgtgggtctctccg cctgagctgttctgcctccggctttgatttcgataacgcctggatgacctgggtcaggc agcctccaggtaagggactggagtgggtgggaagaatcacaggtccaggcgagg gctggtccgtgactacgcggaatctgttaaagggcggtttacaatctcaagggaca ataccaagaataccttgtattgagatgaacaacgtgagaactgaagcaccggat attacttctgtgccagaacaggcaaatactacgactctggtccggctatcccctggc gaggaatattttcaagactggggtcagggaaccccttgttatcgtgtcctccgacaaa ccccatacccaggtgcacctgacacagagcggacccgaagtgcggaagcctggca cctctgtgaaggtgtcctgcaaggcccctggcaacacctgaaaacctacgacctgc actgggtgcgcagcgtgccaggacagggactgcagtggatgggctggatcagcca cgagggcgacaagaaagtgatcgtggaacggttcaaggccaaagtgaccatcgac tgggacagaagcaccaacaccgcctacctgcagctgagcggcctgacctctggcg ataccgccgtgtactactgcgccaagggcagcaagcaccggctgagagactacgc cctgtacgacgatgacggcgcccctgaactgggccgtggatgtggactacctgagca acctggaattctggggccagggcacagccgtgaccgtgtcatctgataagacccac accgcttccaccaagggcccatcggtcttccccctggcaccctcctccaagagcacc tctgggggcacagcggccctgggctgcctggtcaaggactacttccccgaaccggt gacggtgtcgtggaactcaggcgccctgaccagcggcgtgcacaccttcccggct gtcctacagtcctcaggactctactccctcagcagcgtggtgaccgtgccctccagc agcttgggcacccagacctacatctgcaacgtgaatcacaagcccagcaacaccaa ggtggacaagaaagttgagcccaaatcttgtgacaaaactcacacatgcccaccgtg cccagcacctgaactcctggggggaccgtcagtcttcctcttccccccaaaacccaa ggacaccctcatgatctcccggacccctgaggtcacatgcgtggtggtggacgtga gccacgaagaccctgaggtcaagttcaactggtatgttgacggcgtggaggtgcata atgccaagacaaagccgcgggaggagcagtacaacagcacgtaccgtgtggtca gcgtcctcaccgtcctgcaccaggactggctgaatggcaaggagtacaagtgcaag gtctccaacaaagccctcccagcccccatcgagaaaccatctccaaagccaaagg gcagccccgagaaccacaggtgtacaccctgcccccatgccgggatgagctgacc aagaatcaagtcagcctgtggtgcctggtaaaaggcttctatcccagcgacatcgcc gtggagtgggagagcaatgggcagccggagaacaactacaagaccacgcctccc gtgctggactccgacggctccttcttcctctactcaaaactcaccgtggacaagagca ggtggcagcaggggaacgtcttctcatgctccgtgctgcatgaggctctgcacagcc actacacgcagaagagcctctccctgtctccgggt | SEQ ID NO: 246 |

TABLE 2-continued

Heavy and light chain sequences of binding proteins. CDR sequences are bolded and italicized.

| | | |
|---|---|---|
| Light chain B | Gacttcgtgctgacccagagccctcacagcctgagcgtgacacctggcgagagcg ccagcatcagctgcaagagcagccactccctgatccacggcgaccggaacaacta cctggcttggtacgtgcagaagcccggcagatccccccagctgctgatctacctggc cagcagcagagccagcggcgtgcccgatagattttctggcagcggcagcgacaag gacttcacccctgaagatcagccgggtggaaaccgaggacgtgggcacctactactg tatgcagggcagagagagcccctggacctaggccagggcaccaaggtggacatc aaggacaaaacccataccgcatccgaactgactcaggacctgccgtctctgtggc actgaagcagactgtgactattacttgccgaggcgactcactgcggagccactacgc ttcctggtatcagaagaaacccggccaggcacctgtgctgctgttctacggaaagaa caataggccatctggcatccccgaccgcttactggcagtgcatcagggaaccgagc cagtctgaccattaccggcgcccaggctgaggacgaagccgattactattgcagctc ccgggataagagcggctccagactgagcgtgttcggaggaggaactaaactgacc gtcctcgataagacccatacccgtacggtggccgctcccagcgtgacatcttcccac ctagcgacgagcagctgaagtccggcacagcctctgtcgtgtgcctgctgaacaact tctaccccgcgaggcaaagtgcagtggaaggtggacaacgccctgcagagcg caacagccaggaaagcgtgaccgagcaggacagcaaggactccacctacagcc tgagcagcaccctgacactgagcaaggccgactacgagaagcacaaggtgtacgc ctgcgaagtgacccaccagggcctgtctagccccgtgaccaagagcttcaaccgg ggcgagtgt | SEQ ID NO: 247 |

Binding Protein 32 Amino Acid Sequences

| | | |
|---|---|---|
| Heavy chain A | Rahlvqsgtamkkpgasvrvscqtsgytftahilfwfrqapgrglewvgwikpq nygavnfgggfrdrvtltrdvyreiaymdirglkpddtavyycardrsygdsswald awgqgttvvvsaastkgpsvfplapcsrstsestaalgclvkdyfpepvtvswnsg altsgvhtfpavlqssglyslssvvtvpssslgtktytcnvdhkpsntkvdkrvesky gppcppcpapeflggpsvflfppkpkdtlmisrtpevtcvvvdvsqedpevqfn wyvdgvevhnnaktkpreeqfnstyrvvsvltvlhqdwlngkeykckvsnkglps siektiskakgqprepqvytlppcqeemtknqvslwclvkgfypsdiavewesn gqpennykttppvldsdgsfflysktvdksrwqegnvfscsvmhealhnhytqk slslslgk | SEQ ID NO: 302 |
| Light chain A | Yihvtqspsslsvsigdrvtincqtsqgvgsdlhwyqhkpgrapkllihhtssved navpsrfsgsgfhtsfqltisdlqaddiatyycqvlqffgrgsrlhikrtvaapsvfifpp sdeqlksgtasvvcllnnfypreakvqwkvdnalqsgnsqesvteqdskdstysl sstltlskadyekhkvyacevthqglsspvtksfnrgec | SEQ ID NO: 303 |
| Heavy chain B | Qvqlvqsgaevvkpgasvkvsckasgytftsyyhwvrqapgqglewig iypgnvntnyaqkfqgratltvdtsistaymelsrlrsddtavyyctrshygl dwnfdvwgkgttvtvsssqvqlvesgggvvqpgrslrlscaasgftftkaw mhwvrqapgkqlewvaqikdksnyatyyadsvkgrflisrddskntlyl qmnslraedtavyycrgvyyalspfdywgqgtlvtvssrtastkgpsvfpla pcsrstsestaalgclvkdyfpepvtvswnsgaltsgvhtfpavlqssglysls svvtvpssslgtktytcnvdhkpsntkvdkrveskygppcppcpapeflgg psvflfppkpkdtlmisrtpevtcvvvdvsqedpevqfnwyvdgvevhn aktkpreeqfnstyrvvsvltvlhqdwlngkeykckvsnkglpssiektisk akgqprepqvctlppsqeemtknqvslscavkgfypsdiavewesngqp ennykttppvldsdgsfflvskltvdksrwqegnvfscsvmhealhnhytq kslslslgk | SEQ ID NO: 304 |
| Light chain B | Divmtqtplslsvtpgqpasisckssqslvhnnantylswylqkpgqspqsliykv snrfsgvpdrfsgsgsgtdftlkisrveaedvgvyycgqgtqypftfgsgtkveikg qpkaapdiqmtqspsslsasvgdrvtitcqasqniyvwnwyqqkpgkapklliy kasnlhtgvpsrfsgsgsgtdftltisslqpediatyycqqgqtypytfgqgtkleiktk gpsrtvaapsvfifppsdeqlksgtasvvcllnnfypreakvqwkvdnalqsgnsq esvteqdskdstyslsstltlskadyekhkvyacevthqglsspvtksfnrgec | SEQ ID NO: 305 |

Binding Protein 32 Nucleotide Sequences

| | | |
|---|---|---|
| Heavy chain A | agagcccacctggtgcagtctggcaccgccatgaagaaaccaggcgcctctgtgcgg gtgtcctgtcagacaagcggctacacctcaccgcccacatcctgactggttccgggcag gcccctggcagaggactggaatgggtgggatggatcaagcccagtatggcgccgtg aacttcggcggaggcttccgggatagagtgaccctgacccgggacgtgtaccgcgag atcgcctacatggacatccggggcctgaagcccgatgacaccgccgtgtactactgcg ccagagacagaagctacggcgacagcagctgggctctggatgcttggggccagggc acaaccgtggtggtgtctgccgcctctacaaagggcccctcggtgaccctctggccc ttgcagcagaagcaccagcgaatctacagccgccctgggctgcctcgtgaaggactac tttcccgagcccgtgaccgtgtcctggaactctggcgctctgacaagcggcgtgcacac cttcccagccgtgctgccagagcagcggcctgtactctctgagcagcgtcgtgacagtgc ccagcagcagcctgggcaccaagacctacacctgtaacgtggaccacaagcccagca acaccaaggtggacaagcgggtggaatctaagtacggcccctctgccctccttgccc agccccctgaatactgggcggacccctccgtgacctgaccccccaaagcccaaggaca cccctgatgatcagccggaccccgaagtgacctgcgtggtggtggatgtgtcccagga agatcccgaggtgcagttcaattggtacgtggacggcgtggaagtgcacaacgccaa gaccaagccagagaggaacagttcaacagcacctaccgggtggtgtccgtgctgac cgtgctgcaccaggactggctgaacggcaaagagtacaagtgcaaggtgtccaacaa | SEQ ID NO: 306 |

TABLE 2-continued

Heavy and light chain sequences of binding proteins. CDR sequences are bolded and italicized.

| | | |
|---|---|---|
| | gggcctgcccagctccatcgagaaaaccatcagcaaggccaagggccagccccgcg<br>agcctcaagtgtataccctgcccccttgccaggaagagatgaccaagaaccaggtgtc<br>cctgtggtgtctcgtgaaaggcttctaccccagcgacattgccgtggaatgggagagca<br>acggccagcccgagaacaactacaagaccaccccccctgtgctggacagcgacggc<br>tcattcttcctgtactccaagctgaccgtggacaagagccggtggcaggaaggcaacgt<br>gttcagctgctccgtgatgcacgaggccctgcacaaccactacacccagaagtccctgt<br>ctctgtccctgggcaag | |
| Light<br>chain<br>A | Tacatccacgtgacccagagccccagcagcctgtccgtgtccatcggcgacagagtg<br>accatccaactgccagacctctcagggcgtgggcagcgacctgcactggtatcagcaca<br>agcctggcagagcccccaagctgctgatccaccacacaagcagcgtggaagatggc<br>gtgcccagcagattaccggcagcggcttccacaccagcttcaacctgaccatcagcga<br>tctgcaggccgacgacattgccacctactattgtcaggtgctgcagttcttcggcagagg<br>cagcagactgcacatcaagcgtacggtggccgctcccagcgtgacatcttcccaccta<br>gcgacgagcagctgaagtccggcacagcctctgtcgtgtgcctgctgaacaacttctac<br>ccccgcgaggccaaagtgcagtggaaggtggacaacgccctgcagagcggcaaca<br>gccaggaaagcgtgaccgagcaggacagcaaggactccacctacagcctgagcagc<br>accctgacactgagcaaggccgactacgagaagcacaaggtgtacgcctgcgaagtg<br>acccaccagggcctgtctagccccgtgaccaagagcttcaaccggggcgagtgt | SEQ ID<br>NO: 307 |
| Heavy<br>chain<br>B | caggtgcagctggtgcagtctggcgccgaggtcgtgaaacctggcgcctctgtgaag<br>gtgtcctgcaaggccagcggctacacctttaccagctactacatccactgggtgcgcca<br>ggcccctggacagggactggaatggatcggcagcatctaccccggcaacgtgaacac<br>caactacgcccagaagttccagggcagagccaccctgaccgtggacaccagcatcag<br>caccgcctacatggaactgagccggctgagaagcgacgacaccgccgtgtactactg<br>caccccggtcccactacggcctggattggaacttcgacgtgtggggccaagggcaccac<br>cgtgacagtgtctagcagccaggtgcagctggtggaatctggcggcggagtggtgca<br>gcctggcagaagcctgagactgagctgtgccgccagcggcttcaccttcaccaaggc<br>ctggatgcactgggtgcgccaggcccctggaaagcagctggaatgggtggcccagat<br>caaggacaagagcaacagctacgccacctactacgccgacagcgtgaagggccggt<br>tcaccatcagccggacgacagcaagaacaccctgtacctgcagatgaacagcctgc<br>gggccgaggacaccgccgtgtactactgtcggggcgtgtactatgccctgagcccat<br>cgattactggggccagggaaccctcgtgaccgtgtctagtcggaccgccagcacaaa<br>gggcccatcggtgttccctctggcccccttgcagcagaagcaccagcgaatctacagcc<br>gccctgggctgcctcgtgaaggactacttccccgagcccgtgaccgtgtcctggaactc<br>tggcgctctgacaagcggcgtgcacacctttccagccgtgctccagagcagcggcctg<br>tactctctgagcagcgtcgtgacagtgcccagcagcagcctgggcaccaagacctaca<br>cctgtaacgtggaccacaagcccagcaacaccaaggtggacaagcgggtggaatcta<br>agtacggcccctccctgcctccttgcccagccctgaatttctgggcggaccctccgtgt<br>tcctgttccccccaaagcccaaggacacccctgatgatcagccggacccccgaagtgac<br>ctgcgtggtggtggatgtgtcccaggaagatcccgaggtgcagttcaattggtacgtgg<br>acggcgtggaagtgcacaacgccaagaccaagcccagagaggaacagttcaacagc<br>acctaccgggtggtgtccgtgctgaccgtgctgcaccaggactgcctgaacggcaaa<br>gagtacaagtgcaaggtgtccaacaagggcctgcccagctccatcgagaaaaccatc<br>agcaaggccaagggccagccccgcgagcctcaagtgtgtaccctgcccccctagcca<br>ggaagagatgaccaagaaccaggtgtccctgagctgtgccgtgaaaggcttctacccc<br>agcgacattgccgtggaatgggagagcaacggccagcccgagaacaactacaagac<br>caccccccctgtgctggacagcgacggctcattcttcctggtgtccaagctgaccgtgg<br>acaagagccggtggcaggaaggcaacgtgttcagctgctccgtgatgcacgaggccc<br>tgcacaaccactacacccagaagtccctgtctctgtccctgggcaag | SEQ ID<br>NO: 308 |
| Light<br>chain<br>B | gacatcgtgatgacccagacccccctgagcctgagcgtgacacctggacagcctgcc<br>agcatcagctgcaagagcagccagagcctggtgcacaacaacgccaacacctacctg<br>agctggtatctgcagaagcccggccagagcccccagtccctgatctacaaggtgtcca<br>acagattcagcggcgtgcccgacagattctccggcagcggctctggcaccgacttcac<br>cctgaagatcagccgggtggaagccgaggacgtgggcgtgtactattgtggccaggg<br>cacccagtaccccttcacctttggcagcggcaccaaggtggaaatcaagggccagcc<br>caaggccgcccccgacatccagatgacccagagccccagcagcctgtctgccagcgt<br>gggcgacagagtgaccatcacctgtcaggccagcagaacatctacgtgtggctgaa<br>ctggtatcagcagaagcccggcaaggcccccaagctgctgatctacaaggcagcaa<br>cctgcacaccggcgtgcccagcagattttctggcagcggctccggcaccgacttcacc<br>ctgacaatcagctccctgcagcccgaggacattgccacctactactgccagcagggcc<br>agacctacccctacacctttggccagggcaccaagctggaaatcaagaccaagggcc<br>cagccgtacggtggcgctcccagcgtgttcatcttcccaccagcgacgagcagct<br>gaagtccggcacagcctctgtcgtgtgcctgctgaacaacttctaccccgcgaggcc<br>aaagtgcagtggaaggtggacaacgccctgcagagcggcaacagccaggaaagcgt<br>gaccgagcaggacagcaaggactccacctacagcctgagcagcaccctgacactga<br>gcaaggccgactacgagaagcacaaggtgtacgcctgcgaagtgacccaccagggc<br>ctgtctagccccgtgaccaagagcttcaaccggggcgagtgt | SEQ ID<br>NO: 309 |

Binding Protein 33 Amino Acid Sequences

| | | |
|---|---|---|
| Heavy<br>chain<br>A | Rahlvqsgtamkkpgasvrvscqtsgytftahilfwfrqapgrglewvgwikpqy<br>ingavnfgggfrdrvtltrdvyreiaymdirglkpddtavyycardrsygdsswaldaw<br>gqgttvvvsaastkgpsvfplapcsrstsestaalgclvkdyfpepvtvswnsgaltsg<br>vhtfpavlqssglyslssvvtvpssslgtktytcnvdhkpsntkvdkrveskygppcp<br>pcpapeflggpsvflfppkpkdtlmisrtpevtcvvvdvsqedpevqfnwyvdgv | SEQ ID<br>NO: 310 |

TABLE 2-continued

Heavy and light chain sequences of binding proteins. CDR sequences are bolded and italicized.

| | | |
|---|---|---|
| | evhnaktkpreeqfnstyrvvsvltvlhqdwlngkeykckvsnkglpssiektiska kgqprepqvytlppcqeemtknqvslwclvkgfypsdiavewesngqpennykt tppvldsdgsfflyskltvdksrwqegnvfscsvmhealhnhytqkslslslgk | |
| Light chain A | Yihvtqspsslsvsigdrvtincqtsqgvgsdlhwyqhkpgrapkllihhtssvedg nvpsrfsgsgfhtsfqltisdlqaddiatyycqvlqffgrgsrlhikrtvaapsvfifppsd eqlksgtasvvcllnnfypreakvqwkvdnalqsgnsqesvteqdskdstyslsstltl skadyekhkvyacevthqglsspvtksfnrgec | SEQ ID NO: 311 |
| Heavy chain B | Qvqlqesgpglvkpsqtlsltctvsgfslsdygvhwvrqppgkglewlgvi waggtnynpslksrktiskdtsknqvslklssvtaadtavyycardkgysy yysmdywgqgttvtvsssqvqlvesgggvvqpgrslrlscaasgftftkaw mhwvrqapgkqlewvaqikdksnsyatyyadsvkgrftisrddskntlylq mnslraedtavyycrgvyyalspfdywgqgtlvtvssrtastkgpsvfplapc srstsestaalgclvkdyfpepvtvswnsgaltsgvhtfpavlqssglyslssvv tvpssslgtktytcnvdhkpsntkvdkrveskygppcppcpapefllgpsvf lfppkpkdtlmisrtpevtcvvvdvsqedpevqfnwyvdgvevhnaktkp reeqfnstyrvvsvltvlhqdwlngkeykckvsnkglpssiektiskakgqpr epqvctlppsqeemtknqvslscavkgfypsdiavewesngqpennykttt ppvldsdgsfflvskltvdksrwqegnvfscsvmhealhnhytqkslslslgk | SEQ ID NO: 312 |
| Light chain B | Divmtqtplslsvtpgqpasisckssqslvhnnantylswylqkpgqspqsliykvs nnrfsgvpdrfsgsgsgtdftlkisrveaedvgvyycgqgtqypftfgsgtkveikgqp kaapdivltqspaslavspgqratitcrasesveyyvtslqwyqqkpgqppkllifa asnvesgvparfsgsgsgtdftltinpveandvanyycqqsrkvpytfgqgtkleikt kgpsrtvaapsvfifppsdeqlksgtasvvcllnnfypreakvqwkvdnalqsgnsq esvteqdskdstyslsstltlskadyekhkvyacevthqglsspvtksfnrgec | SEQ ID NO: 313 |

Binding Protein 33 Nucleotide Sequences

| | | |
|---|---|---|
| Heavy chain A | agagcccacctggtgcagtctggcaccgccatgaagaaaccaggcgcctctgtgcgg tgtcctgtcagacaagcggctacaccttcaccgcccacatcctgactggttccggcag gcccctggcagaggactggaatgggtgggatggatcaagcccagtatggcgccgtg aacttcggcggaggcttccgggatagagtgaccctgacccgggacgtgtaccgcgag atcgcctacatggacatccggggcctgaagcccgatgacaccgccgtgtactactgcg ccagagacagaagctacgcgacagcagctgggctctggatgcttggggccagggc acaaccgtggtggtgtctgccgcctctacaaagggcccctcggtgaccctctggcccc ttgcagcagaagcaccagcgaatctacagccgccctgggctgcctcgtgaaggactac tttcccgagccgtgaccgtgtcctggaactctggcgctctgacaagcggcgtgcacac ctttccagccgtgctcagagcagcggcctgtactctctgagcagcgtcgtgacagtgc ccagcagcagcctgggcaccaagacctacacctgtaacgtggaccacaagcccagca acaccaaggtggacaagcgggtggaatctaagtacggccctccctgccctccttgccc agcccctgaatactgggcgaaccctccgtgacctgacccccccaaagcccaaggaca ccctgatgatcagccggaccccccgaagtgacctgcgtggtggtggatgtgtcccagga agatcccgaggtgcagttcaattggtacgtggacggcgtggaagtgcacaacgccaa gaccaagcccagagaggaacagttcaacagcacctaccgggtggtgtccgtgctgac cgtgctgcaccaggactggctgaacggcaaagagtacaagtgcaaggtgtccaacaa gggcctgcccagctccatcgagaaaaccatcagcaaggccaaggcagccccgcg agcctcaagtgtataccctgccccccttgccaggaagagatgaccaagaaccaggtgtc cctgtggtgtctcgtgaaaggcttctaccccagcgacattgccgtggaatgggagagca acggccagcccgagaacaactacaagaccacccccctgtgctggacagcgacggc tcattcttcctgtactccaagctgaccgtggacaagagccggtggcaggaaggcaacgt gttcagctgctccgtgatgcacgaggccctgcacaaccactacacccagaagtccctgt ctctgtccctgggcaag | SEQ ID NO: 314 |
| Light chain A | Tacatccacgtgacccagagccccagcagcctgtccgtgtccatcggcgacagagtg accatcaactgccagacctctcagggcgtgggcagcgacctgcactggtatcagcaca agcctggcagagcccccaagctgctgatccaccacacaagcagcgtggaagatggc gtgcccagcagattaccggcagcggcttccacaccagcttcaacctgaccatcagcga tctgcaggccgacgacattgccacctactattgtcaggtgctgcagttcttcggcagg cagcagactgcacatcaagcgtacggtggccgctcccagcgtgttcatcttcccaccta gcgacgagcagctgaagtccggcacagcctctgtcgtgtgcctgctgaacaacttctac ccccgcgaggccaaagtgcagtggaaggtggacaacgccctgcagagcggcaaca gccaggaaagcgtgacccagcaggacagcaaggactccacctacagcctgagcagc accctgacactgagcaaggccgactacgagaagcacaaggtgtacgcctgcgaagtg acccaccagggcctgtctagccccgtgaccaagagcttcaaccggggcgagtgt | SEQ ID NO: 315 |
| Heavy chain B | caggtgcagctgcaggaatctggccctggcctcgtgaagcctagccagaccctgagc ctgacctgtaccgtgtccggcttcagcctgagcgactacggcgtgcactgggtgcgcc agccacctggaaaggcctggaatgggtgggcgtgatctggctggcggaggcacc aactacaaccccagcctgaagtccagaaagaccatcagcaaggacaccagcaagaac caggtgtccctgaagctgagcagcgtgaccgccgataccgccgtgtactactgcg ccagagacaagggctacagctactactacagcatggactactggggccagggcacca ccgtgaccgtgtcatcctctcaggtgcagctggtggaatctggcggcggagtggtgca gcctggcagaagcctgagactgagctgtgccgccagcggcttcaccttcaccaaggc ctggatgcactgggtgcgccaggcccctggaaagcagctggaatgggtggcccagat caaggacaagagcaacagctacgccacctactacgccgacagcgtgaagggccgt | SEQ ID NO: 316 |

TABLE 2-continued

Heavy and light chain sequences of binding proteins. CDR sequences are bolded and italicized.

|  |  |
|---|---|
| | tcaccatcagccgggacgacagcaagaacaccctgtacctgcagatgaacagcctgc<br>gggccgaggacaccgccgtgtactactgtcggggcgtgtactatgccctgagcccctt<br>cgattactggggccagggaaccctcgtgaccgtgtctagtcggaccgcttcgaccaag<br>ggcccatcggtgttccctctggccccttgcagcagaagcaccagcgaatctacagccg<br>ccctgggctgcctcgtgaaggactactttcccgagcccgtgaccgtgtcctggaactct<br>ggcgctctgacaagcggcgtgcacaccttccagccgtgctccagagcagcgcctgt<br>actctctgagcagcgtcgtgacagtgcccagcagcagcctgggcaccaagacctaca<br>cctgtaacgtggaccacaagcccagcaacaccaaggtggacaagcgggtggaatcta<br>agtacggccctcccgccctccttgcccagccccgaatttctgggcggaccctccgtgt<br>tcctgttcccccaaagcccaaggacaccctgatgatcagccggaccccccgaaggtgac<br>ctgcgtggtggtggatgtgtcccaggaagatcccgaggtgcagttcaattggtacgtgg<br>acggcgtggaagtgcacaacgccaagaccaagcccagagaggaacagttcaacagc<br>acctaccgggtggtgtccgtgctgaccgtgctgcaccaggactggctgaacggcaaa<br>gagtacaagtgcaaggtgtccaacaagggcctgcccagctccatcgagaaaaccatc<br>agcaaggccaagggccagccccgcgagcctcaagtgtgtaccctgcccctagcca<br>ggaagagatgaccaagaaccaggtgtccctgagctgtgccgtgaaaggcttctacccc<br>agcgacattgccgtggaatgggagagcaacggccagcccgagaacaactacaagac<br>cacccccctgtgctggacagcgacggctcattcttcctggtgtccaagctgaccgtgg<br>acaagagccggtggcaggaaggcaacgtgttcagctgctccgtgatgcacgaggccc<br>tgcacaaccactacacccagaagtccctgtctctgtccctgggcaag | |
| Light<br>chain<br>B | gacatcgtgatgacccagacccccctgagcctgagcgtgacacctggacagcctgcc<br>agcatcagctgcaagagcagccagagcctggtgcacaacaacgccaacacctacctg<br>agctggtatctgcagaagcccggccagagccccagtccctgatctacaaggtgtcca<br>acagattcagcggcgtgcccgacagattctccggcagcggctctggcaccgacttcac<br>cctgaagatcagccggtggaagccgaggacgtgggcgtgtactattgtggccaggg<br>cacccagtacccccttcaccttggcagcggcaccaaggtggaaatcaagggccagcc<br>caaggccgcccccgacatcgtgctgacacagagccctgctagcctggccgtgtctcct<br>ggacagagggccaccatcacctgtagagccagcgagagcgtggaatattacgtgacc<br>agcctgatgcagtggtatcagcagaagcccggccagccccccaagctgctgatttcg<br>ccgccagcaacgtgaaagcggcgtgccagccagattttccggcagcggctctggca<br>ccgacttcacccctgaccatcaaccccgtggaagcaacgacgtggccaactactactg<br>ccagcagagccggaaggtgccctacacctttggccagggcaccaagctggaaatcaa<br>gaccaagggcccagccgtacggtggccgctcccagcgtgttcatcttcccacctagc<br>gacgagcagctgaagtccggcacagcctctgtcgtgtgcctgctgaacaacttctaccc<br>ccgcgaggccaaagtgcagtggaaggtggacaacgccctgcagagcggcaacagc<br>caggaaagcgtgaccgagcaggacagcaaggactccacctacagcctgagcagcac<br>cctgacactgagcaaggccgactacgagaagcacaaggtgtacgcctgcgaagtgac<br>ccaccagggcctgtctagccccgtgaccaagagcttcaaccggggcgagtgt | SEQ ID<br>NO: 317 |

Binding Protein 34 Amino Acid Sequences

| | | |
|---|---|---|
| Heavy<br>chain<br>A | Qvhltqsgpevrkpgtsvkvsckapgntlktydlhwvrsvpgqqlqwmgwishe<br>ingdkkviverfkakvtidwdrstntaylqlsgltsgdtavyycakgskhrlrdyalydd<br>dgalnwavdvdylsnlefwgqgtavtvssastkgpsvfplapcsrstsestaalgclv<br>kdyfpepvtvswnsgaltsgvhtfpavlqssglyslssvvtvpssslgtktytcnvdh<br>kpsntkvdkrveskygppcppcpapeflggpsvflfppkpkdtlmisrtpevtcvv<br>vdvsqedpevqfnwyvdgvevhnaktkpreeqfnstyrvvsvltvlhqdwlngke<br>ykckvsnkglpssiektiskakgqprepqvytlppcqeemtknqvslwclvkgfyp<br>sdiavewesngqpennykttppvldsdgsfflysklvdksrwqegnvfscsvmhe<br>alhnhytqkslslslgk | SEQ ID<br>NO: 318 |
| Light<br>chain<br>B | Dfvltqsphslsvtpgesasisckssнslihgdrnnylawyvqkpgrspqlliylassr<br>asgvpdrfsgsgsdkdftlkisrvetedvgtyycmqgrespwtfgqgtkvdikrtva<br>apsvfifppsdeqlksgtasvvcllnnfypreakvqwkvdnalqsgnsqesvteqds<br>kdstyslsstltlskadyekhkvyacevthqglsspvtksfnrgec | SEQ ID<br>NO: 319 |
| Heavy<br>chain<br>B | Qvqlvqsgaevvkpgasvkvsckas*qytftsyy*ihwvrqapgqglewigs*i*<br>*ypgnvnt*nyaqkfqgratltvdtsistaymelsrlrsddtavyyc*trshygldw*<br>*nfdv*wgkgttvtvsssqvqlvesgggvvqpgrslrlscaas*gftftkaw*mh<br>wvrqapgkqlewvaq*ikdksns*yatyyadsvkgrftisrddskntlylqmn<br>slraedtavyy*rgvyyalspfdy*wgqgtlvtvssrtastkgpsvfplapcsrst<br>sestaalgclvkdyfpepvtvswnsgaltsgvhtfpavlqssglyslssvvtvp<br>ssslgtktytcnvdhkpsntkvdkrveskygppcppcpapeflggpsvflfp<br>pkpkdtlmisrtpevtcvvvdvsqedpevqfnwyvdgvevhnaktkpree<br>qfnstyrvvsvltvlhqdwlngkeykckvsnkglpssiektiskakgqprep<br>qvctlppsqeemtknqvslscavkgfypsdiavewesngqpennykttpp<br>vldsdgsfflvsklvdksrwqegnvfscsvmhealhnhytqkslslslgk | SEQ ID<br>NO: 320 |
| Light<br>chain<br>B | Divmtqtplslsvtpgqpasisckss*qslvhnnanty*swylqkpgqspqsliy*kvs*<br>nnrfsgvpdrfsgsgsgtdftlkisrveaedvgvyyc*gqgtqyp*ftfgsgtkveikgqp<br>kaapdiqmtqspsslsasvgdrvtitcqasqniyvwnyqqkpgkapkliy*kas*<br>nlhtgvpsrfsgsgsgtdftltisslqpediatyyc*qqgqtypyt*gqgtkleiktkgpsr<br>tvaapsvfifppsdeqlksgtasvvcllnnfypreakvqwkvdnalqsgnsqesvte<br>qdskdstyslsstltlskadyekhkvyacevthqglsspvtksfnrgec | SEQ ID<br>NO: 321 |

TABLE 2-continued

Heavy and light chain sequences of binding proteins. CDR sequences are bolded and italicized.

Binding Protein 34 Nucleotide Sequences

Heavy chain A caggtgcacctgacacagagcggacccgaagtgcggaagcctggcacctctgtgaa
ggtgtcctgcaaggcccctggcaacaccctgaaaacctacgacctgcactgggtgcgc
agcgtgccaggacagggactgcagtggatgggctggatcagccacgagggcgacaa
gaaagtgatcgtggaacggttcaaggccaaagtgaccatcgactgggacagaagcac
caacaccgcctacctgcagctgagcggcctgacctctggcgataccgccgtgtactact
gcgccaagggcagcaagcaccggctgagagactacgccctgtacgacgatgacggc
gccctgaactgggccgtggatgtggactacctgagcaacctggaattctggggccagg
gcacagccgtgaccgtgtcatctgcttcgaccaagggccctcggtgttccctctggcc
ccttgcagcagaagcaccagcgaatctacagccgccctgggctgcctcgtgaaggact
actttcccgagcccgtgaccgtgtcctggaactctggcgctctgacaagcggcgtgcac
acctaccagccgtgctccagagcagcggcctgtactctctgagcagcgtcgtgacagt
gcccagcagcagcctgggcaccaagacctacacctgtaacgtggaccacaagccca
gcaacaccaaggtggacaagcgggtggaatctaagtacggccctccctgccctccttg
cccagcccctgaatactgggcggaccctccgtgacctgttcccccaaagcccaagg
acaccctgatgatcagccggacccccgaagtgacctgcgtggtggtggatgtgtccca
ggaagatcccgaggtgcagttcaattggtacgtggacggcgtggaagtgcacaacgc
caagaccaagcccagagaggaacagttcaacagcaccaccgggtggtgtccgtgct
gaccgtgctgcaccaggactggctgaacggcaaagagtacaagtgcaaggtgtccaa
caagggcctgcccagctccatcgagaaaaccatcagcaaggccaagggccagcccc
gcgagcctcaagtgtataccctgccccctgccaggaagagatgaccaagaaccaggt
gtccctgtggtgtctcgtgaaaggcttctaccccagcgacattgccgtggaatgggaga
gcaacggccagcccgagaacaactacaagaccacccccctgtgctggacagcgac
ggctcattcttcctgtactccaagctgaccgtggacaagagccggtggcaggaaggca
acgtgttcagctgctccgtgatgcacgaggccctgcacaaccactacacccagaagtc
cctgtctctgtccctgggcaag

SEQ ID NO: 322

Light chain A gacttcgtgctgacccagagccctcacagcctgagcgtgacacctggcgagagcgcc
agcatcagctgcaagagcagccactccctgatccacggcgaccggaacaactacctg
gcttggtacctgcagaagcccggcagatcccccagctgctgatctacctggccagca
gcagagccagcggcgtgcccgatagatttctggcagcggcagcgacaaggacttca
ccctgaagatcagccgggtggaaaccgaggacgtgggcacctactactgtatgcagg
gcagagagagcccctggacctttggccagggcaccaaggtggacatcaagcgtacg
gtggccgctcccagcgtgttcatcttcccacctagcgacgagcagctgaagtccggca
cagcctctgtcgtgtgcctgctgaacaacttctaccccgcgaggccaaagtgcagtgg
aaggtggacaacgccctgcagagcggcaacagccaggaaagcgtgaccgagcagg
acagcaaggactccacctacagcctgagcagcaccctgacactgagcaaggccgact
acgagaagcacaaggtgtacgcctgcgaagtgacccaccagggcctgtctagccccg
tgaccaagagcttcaaccggggcgagtgt

SEQ ID NO: 323

Heavy chain B caggtgcagctggtgcagtctggcgccgaggtcgtgaaacctggcgcctctgtgaag
gtgtcctgcaaggccagcggctacacctttaccagctactacatgcactgggtgcgcca
ggcccctggacagggactggaatggatcggcagcatctaccccggcaacgtgaacac
caactacgcccagaagttccagggcagagccaccctgaccgtggacaccagcatcag
caccgcctacatggaactgagccgcctgagaagcgacgacaccgccgtgtactactg
caccggtcccactacggcctggattggaacttcgacgtgtggggccaagggcaccac
cgtgacagtgtctagcagccaggtgcagctggtggaatctggcggcggagtggtgca
gcctggcagaagcctgagactgagctgtgccgccagcggcttcaccttcaccaaggc
ctggatgcactgggtgcgccaggcccctggaaagcagctggaatgggtggcccagat
caaggacaagagcaacagctacgccacctactacgccgacagcgtgaagggccggt
tcaccatcagccgggacgacagcaagaacaccctgtacctgcagatgaacagcctgc
gggccgaggacaccgccgtgtactactgtcggggcgtgtactatgccctgagcccctt
cgattactggggccagggaaccctcgtgaccgtgtctagtcggaccgccagcacaaa
gggcccatcggtgttccctctggccccttgcagcagaagcaccagcgaatctacagcc
gccctgggctgcctcgtgaaggactacttttcccgagcccgtgaccgtgtcctggaactc
tggcgctctgacaagcggcgtgcacacctttccagccgtgctccagagcagcggcctg
tactctctgagcagcgtcgtgacagtgcccagcagcagcctgggcaccaagacctaca
cctgtaacgtggaccacaagcccagcaacaccaaggtggacaagcgggtggaatcta
agtacggccctccctgccctccttgcccagcccctgaattctgggcggaccctccgtgt
cctgttccccccaaagcccaaggacaccctgatgatcagccggacccccgaagtgac
ctgcgtggtggtggatgtgtcccaggaagatcccgaggtgcagttcaattggtacgtgg
acggcgtggaagtgcacaacgccaagaccaagcccagagaggaacagttcaacagc
acctaccgggtggtgtccgtgctgaccgtgctgcaccaggactggctgaacggcaaa
gagtacaagtgcaaggtgtccaacaagggcctgcccagctccatcgagaaaaccatc
agcaaggccaagggccagccccgcgagcctcaagtgtgtaccctgcccccctagcca
ggaagagatgaccaagaaccaggtgtccctgagctgtgccgtgaaaggcttctacccc
agcgacattgccgtggaatgggagagcaacggccagcccgagaacaactacaagac
caccccccctgtgctggacagcgacggctcattcttcctggtgtccaagctgaccgtgg
acaagagccggtggcaggaaggcaacgtgttcagctgctccgtgatgcacgaggccc
tgcacaaccactacacccagaagtccctgtctctgtccctgggcaag

SEQ ID NO: 324

Light chain B gacatcgtgatgacccagacccccctgagcctgagcgtgacacctggacagcctgcc
agcatcagctgcaagagcagcagagcctggtgcacaacaacgccaacacctacctg
agctggtatctgcagaagcccggccagagcccccagtccctgatctacaaggtgtcca
acagattcagcggcgtgcccgacagattctccggcagcggctctggcaccgacttcac
cctgaagatcagccgggtggaagccgaggacgtgggcgtgtactattgtggccaggg TABLE 2-continued Heavy and light chain sequences of binding proteins. CDR sequences are bolded and italicized.

```
cacccagtaccccttcacctttggcagcggcaccaaggtggaaatcaagggccagcc
caaggccgcccccgacatccagatgacccagagccccagcagcctgtctgccagcgt
gggcgacagagtgaccatcacctgtcaggccagcagaacatctacgtgtggctgaa
ctggtatcagcagaagcccggcaaggcccccaagctgctgatctacaaggccagcaa
cctgcacaccggcgtgcccagcagattttctggcagcggctccggcaccgacttcacc
ctgacaatcagctccctgcagcccgaggacattgccacctactactgccagcagggcc
agacctaccccctacacctttggccagggcaccaagctggaaatcaagaccaagggcc
ccagccgtacggtggccgctcccagcgtgacatcttcccacctagcgacgagcagct
gaagtccggcacagcctctgtcgtgtgcctgctgaacaacttctaccccgcgaggcc
aaagtgcagtggaaggtggacaacgccctgcagagcggcaacagccaggaaagcgt
gaccgagcaggacagcaaggactccacctacagcctgagcagcaccctgacactga
gcaaggccgactacgagaagcacaaggtgtacgcctgcgaagtgacccaccagggc
ctgtctagccccgtgaccaagagcttcaaccggggcgagtgt
```

Binding Protein 35 Amino Acid Sequences

| Heavy chain A | Qvhltqsgpevrkpgtsvkvsckapgntlktydlhwvrsvpgqglqwmgwishe chaingdkkviverfkakvtidwdrstntaylqlsgltsgdtavyycakgskhrlrdyalydd dgalnwavdvdylsnlefwgqgtavtvssastkgpsvfplapcsrstsestaalgclv kdyfpepvtvswnsgaltsgvhtfpavlqssglyslssvvtvpssslgtktytcnvdh kpsntkvdkrveskygppcppcpapeflggpsvflfppkpkdtlmisrtpevtcvv vdvsqedpevqfnwyvdgvevhnaktkpreeqfnstyrvvsvltvlhqdwlngke ykckvsnkglpssiektiskakgqprepqvytlppcqeemtknqvslwclvkgfyp sdiavewesngqpennykttppvldsdgsfflyskltvdksrwqegnvfscsvmhe alhnhytqkslslslgk | SEQ ID NO: 326 |
|---|---|---|
| Light chain B | Dfvltqsphslsvtpgesasisckssshslihgdrnnylawyvqkpgrspqlliylassr asgvpdrfsgsgsdkdftlkisrvetedvgtyycmqgrespwtfgqgtkvdikrtva apsvfifppsdeqlksgtasvvcllnnfypreakvqwkvdnalqsgnsqesvteqds kdstyslsstltlskadyekhkvyacevthqglsspvtksfnrgec | SEQ ID NO: 327 |
| Heavy chain B | Qvqlqesgpglvkpsqtlsltctvsgfslsdygvhwvrqppgkglewlgvi chainwagggtnynpslksrktiskdtsknqvslklssvtaadtavyycardkgysy yysmdywgqgttvtvsssqvqlvesgggvvqpgrslrlscaasgftftkaw mhwvrqapgkqlewvaqikdksnsyatyyadsvkgrftisrddskntlylq mnslraedtavyycrgvyyalspfdywgqgtlvtvssrtastkgpsvfplapc srstsestaalgclvkdyfpepvtvswnsgaltsgvhtfpavlqssglyslssvv tvpssslgtktytcnvdhkpsntkvdkrveskygppcppcpapeflggpsvf lfppkpkdtlmisrtpevtcvvvdvsqedpevqfnwyvdgvevhnaktkp reeqfnstyrvvsvltvlhqdwlngkeykckvsnkglpssiektiskakgqpr epqvctlppsqeemtknqvslscavkgfypsdiavewesngqpennyktt ppvldsdgsfflvskltvdksrwqegnvfscsvmhealhnhytqkslslslgk | SEQ ID NO: 328 |
| Light chain B | Divmtqtplslsvtpgqpasisckssqslvhnnantylswylqkpgqspqsliykvs nnrfsgvpdrfsgsgsgtdftlkisrveaedvgvyycgqgtqypftfgsgtkveikgqp kaapdivltqspaslavspgqratitcrasesveyyvtslqwyqqkpgqppkllifa asnvesgvparfsgsgsgtdftltinpveandvanyycqqsrkvpytfgqgtkleikt kgpsrtvaapsvfifppsdeqlksgtasvvcllnnfypreakvqwkvdnalqsgnsq esvteqdskdstyslsstltlskadyekhkvyacevthqglsspvtksfnrgec | SEQ ID NO: 329 |

Binding Protein 35 Nucleotide Sequences

| Heavy chain A | caggtgcacctgacacagagcggacccgaagtgcggaagcctggcacctctgtgaa ggtgtcctgcaaggcccctggcaacaccctgaaaacctacgacctgcactgggtgcgc agcgtgccaggacagggactgcagtggatgggctggatcagccacgagggcgacaa gaaagtgatcgtggaacggttcaaggccaaagtgaccatcgactgggacagaagcac caacaccgcctacctgcagctgagcggcctgacctctggcgataccgccgtgtactact gcgccaagggcagcaagcaccggctgagagactacgccctgtacgacgatgacggc gccctgaactgggccgtggatgtggactacctgagcaacctggaattctggggccagg gcacagccgtgaccgtgtcatctgcttcgaccaagggccccctcggtgttccctctgcc ccttgcagcagaagcaccagcgaatctacagccgccctgggctgcctcgtgaaggact actttcccgagcccgtgaccgtgtcctggaactctggcgctctgacaagcggcgtgcac acctaccagccgtgctccagagcagcggcctgtactctctgagcagcgtcgtgacagt gcccagcagcagcctgggcaccaagacctacacctgtaacgtggaccacaagccca gcaacaccaaggtggacaagcgggtggaatctaagtacggccctccctgccctccttg cccagcccctgaatactgggcggacctccgtgacctgttcccccccaaagcccaagg acaccctgatgatcagccggacccccgaagtgacctgcgtggtggtggatgtgtccca ggaagatcccgaggtgcagacaattggtacgtggacggcgtggaagtgcacaacgc caagaccaagcccagagaggaacagttcaacagcacctaccgggtggtgtccgtgct gaccgtgctgcaccaggactggctgaacggcaaagagtacaagtgcaaggtgtccaa caagggcctgcccagctccatcgagaaaaccatcagcaaggccaagggccagcccc gcgagcctcaagtgtataccctgccccccagccaggaagagatgaccaagaaccaggt gtccctgtggtgtctcgtgaaggcttctacccccagcgacattgccgtggaatgggaga gcaacggccagcccgagaacaactacaagaccacccccctgtgctggacagcgac ggctcattcacctgtactccaagctgaccgtggacaagagccggtggcaggaaggca acgtgacagctgctccgtgatgcacgaggcccctgcacaaccactacacccagaagtc cctgtctctgtccctgggcaag | SEQ ID NO: 330 |

TABLE 2-continued

Heavy and light chain sequences of binding proteins. CDR sequences are bolded and italicized.

| | | |
|---|---|---|
| Light chain A | gacttcgtgctgacccagagccctcacagcctgagcgtgacacctggcgagagcgcc agcatcagctgcaagagcagccactccctgatccacggcgaccggaacaactacctg cttggtacgtgcagaagcccggcagatcccccagctgctgatctacctggccagca gcagagccagcggcgtgcccgatagattactggcagcggcagcgacaaggacttca ccctgaagatcagccgggtggaaaccgaggacgtgggccctactactgtatgcagg gcagagagagcccctgacctaggccagggcaccaaggtggacatcaagcgtacg gtggccgctcccagcgtgacatcacccacctagcgacgagcagctgaagtccggca cagcctctgtcgtgtgcctgctgaacaacttctaccccgcgaggccaaagtgcagtgg aaggtggacaacgccctgcagagcggcaacagccaggaaagcgtgaccgagcagg acagcaaggactccacctacagcctgagcagcaccctgacactgagcaaggccgact acgagaagcacaaggtgtacgcctgcgaagtgacccaccagggcctgtctagccccg tgaccaagagcttcaaccggggcgagtgt | SEQ ID NO: 331 |
| Heavy chain B | caggtgcagctgcaggaatctggccctggcctcgtgaagcctagccagaccctgagc ctgacctgtaccgtgtccggcttcagcctgagcgactacggcgtgcactgggtgcgcc agccacctggaaaaggcctggaatggctgggcgtgatctgggctggcggaggcacc aactacaacccagcctgaagtccagaaagaccatcagcaaggacaccagcaagaac caggtgtccctgaagctgagcagcgtgacagccgccgataccgccgtgtactactgcg ccagagacaagggctacagctactactacagcatggactactggggccagggcacca ccgtgaccgtgtcatcctctcaggtgcagctggtggaatctggcggcggagtggtgca gcctggcagaagcctgagactgagctgtgccgccagcggcttcaccttcaccaaggc ctggatgcactgggtgcgccaggcccctggaaagcagctggaatgggtggcccagat caaggacaagagcaacagctacgccacctactacgccgacagcgtgaagggccggt tcaccatcagccgggacgacagcaagaacaccctgtacctgcagatgaacagcctgc gggccgaggacaccgccgtgtactactgtcggggcgtgtactatgccctgagcccat cgattactggggccagggaaccctcgtgaccgtgtctagtcggacccgcttcgaccaag ggcccatcggtgaccctctggcccttgcagcagaagcaccagcgaatctacagccg ccctgggctgcctcgtgaaggactactacccgagcccgtgaccgtgtcctggaactct ggcgctctgacaagcggcgtgcacacctaccagcgtgctccagagcagcggcctgt actctctgagcagcgtcgtgacagtgcccagcagcagcctggtgaccgtgcccctaca cctgtaacgtggaccacaagcccagcaacaccaaggtggacaagcgggtggaatcta agtacggccctccctgcctccttgcccagccctgaatactgggcggaccctccgtgt tcctgaccccccaaagcccaaggacaccctgatgatcagccggacccccgaagtgac ctgcgtggtggtggatgtgtcccaggaagatcccgaggtgcagaacaattggtacgtgg acggcgtggaagtgcacaacgccaagaccaagcccagagaggaacagttcaacagc acctaccgggtggtgtccgtgctgaccgtgctgcaccaggactggctgaacggcaaa gagtacaagtgcaaggtgtccaacaagggcctgcccagctccatcgagaaaaccatc agcaaggccaagggccagccccgcgagcctcaagtgtgtaccctgccccctagcca ggaagagatgaccaagaaccaggtgtccctgagctgtgccgtgaaaggcactaccc agcgacattgccgtggaatgggagagcaacggccagcccgagaacaactacaagac cacccccctgtgctggacagcgacggctcattcacctggtgtccaagctgaccgtgg acaagagccgggtggcaggaaggcaacgtgacagctgctccgtgatgcacgaggccc tgcacaaccactacacccagaagtccctgtctctgtcctgggcaag | SEQ ID NO: 332 |
| Light chain B | gacatcgtgatgacccagacccccctgagcctgagcgtgacacctggacagcctgcc agcatcagctgcaagagcagccagagcctggtgcacaacaacgccaacacctacctg agctggtatctgcagaagcccggcagagcccccagtccctgatctacaaggtgtcca acagattcagcggcgtgcccgacagattctccggcagcggctctggcaccgacttcac cctgaagatcagccgggtggaagccgaggacgtgggcgtgtactattgtggccaggg cacccagtacccccacaccaggcagcggcaccaaggtggaaatcaagggccagcc caaggccgcccccgacatcgtgctgacacagagccctgctagcctggccgtgtctcct ggacagagggccaccatcacctgtagagccagcgagagcgtggaatattacgtgacc agcctgatgcagtggtatcagcagaagcccggccagcccccaagctgctgattacg ccgccagcaacgtggaaagcggcgtgccagccagattaccggcagcggctctggca ccgacttcaccctgaccatcaaccccgtggaagccaacgacgtggccaactactactg ccagcagagccggaaggtgccctacacctaggccagggcaccaagctggaaatcaa gaccaagggcccagccgtacggtggccgctcccagcgtgacatcacccacctagc gacgagcagctgaagtccggcacagcctctgtcgtgtgcctgctgaacaacttctaccc ccgcgaggccaaagtgcagtgaaggtggacaacgccctgcagagcggcaacagc caggaaagcgtgaccgagcaggacagcaaggactccacctacagcctgagcagcac cctgacactgagcaaggccgactacgagaagcacaaggtgtacgcctgcgaagtgac ccaccagggcctgtctagccccgtgaccaagagcttcaaccggggcgagtgt | SEQ ID NO: 333 |

Binding Protein 36 Amino Acid Sequences

| | | |
|---|---|---|
| Heavy chain A | Qvqlvqsggqmkkpgesmriscrasgyefidctlnwirlapgkrpewmgwlkpr inggavnyarplqgrvtmadvysdtaflelrsltvddtavyfctrgkncdynwdfehw grgtpvivssastkgpsvfplapcsrstsestaalgclvkdyfpepvtvswnsgaltsg vhtfpavlqssglyslssvvtvpssslgtktytcnvdhkpsntkvdkrveskygppcp pcpapeflggpsvflfppkpkdtlmisrtpevtcvvvdvsqedpevqfnwyvdgv evhnaktkpreeqfnstyrvvsvltvlhqdwlngkeykckvsnkglpssiektiska kgqprepqvytlppcqeemtknqvslwclvkgfypsdiavewesngqpennykt tppvldsdgsfflyskltvdksrwqegnvfscsvmhealhnhytqkslslslgk | SEQ ID NO: 334 |

TABLE 2-continued

Heavy and light chain sequences of binding proteins. CDR sequences are bolded and italicized.

| | | |
|---|---|---|
| Light chain A | Eivltqspgtlslspgetaiiscrtsqygslawyqqrpgqaprlviysgstraagipdrfs sgsrwgpdynltisnlesgdfgvyycqqyeffgqgtkvqvdikrtvaapsvfifppsd eqlksgtasvvcllnnfypreakvqwkvdnalqsgnsqesvteqdskdstyslsstltl skadyekhkvyacevthqglsspvtksfnrgec | SEQ ID NO: 335 |
| Heavy chain B | Qvqlvqsgaevykpgasykysckas*gytftsyy*hwvrqapgqglewigs*i ypgnvnt*nyaqkfqgratltvdtsistaymelsrlrsddtavyyc*trshygld wnfdv*wgkgttvtvssssqvqlvesggggvvqpgrslrlscaas*gftftkaw*m hwvrqapgkqlewvaq*ikdksns*yatyyadsvkgrftisrddsknt1ylqm nslraedtavyyc*rgvyyalspfdy*wgqgtlvtvssrtastkgpsvfplapcsr stsestaalgclvkdyfpepvtvswnsgailsgvhtfpavlqssglyslssvvt vpsssLgtktytcnvdhkpsntkvdkrveskygppcppcpapefLggpsvfL fppkpkdtlmisrtpevtcyvvdvsqedpevqfnwyvdgvevhnaktkpr eeqfnstyrvvsvltylhqdwlngkeykckvsnkglpssiektiskakgqpr epqvctlppsqeemtknqvslscavkgfypsdiavewesngqpennyktt ppvldsdgsfflvskltvdksrwqegnvfscsvmhealhnhytqkslslslg k | SEQ ID NO: 336 |
| Light chain B | Divmtqtplslsvtpgqpasiscks*sqslvhnnanty*swylqkpgqspqsliy*kvs*nrfsgvpdrfsgsgsgtdftlkisrveaedvgvyyc*gqgtqyp*ftfgsgtkveikgqp kaapdiqmtqspsslsasvgdrvtitcqas*qniyvw*nwyqqkpgkapklliy*kas* nlhtgvpsrfsgsgsgtdftltisslqpediatyyc*qqgqtypyt*fgqgtkleiktkgpsr tvaapsvfifppsdeqlksgtasvvcllnnfypreakvqwkvdnalqsgnsqesvte qdskdstyslsstltlskadyekhkvyacevthqglsspvtksfnrgec | SEQ ID NO: 337 |

Binding Protein 36 Nucleotide Sequences

| | | |
|---|---|---|
| Heavy chain A | caggtgcagctggtgcagtctggcggccagatgaagaaaccggcgagagcatgcg atcagctgcagagccagcggctacgagacatcgactgcaccctgaactggatcaga ctggcccctggcaagcggcctgagtggatgggatggctgaagcctagaggcggagc cgtgaactacgccagacctctgcagggcagagtgaccatgacccgggacgtgtacag cgataccgccttcctggaactgcggagcctgaccgtggatgataccgccgtgtacttct gcacccggggcaagaactgcgactacaactgggacttcgacgtctggggccagagcc accctgtgatcgtgtcaagcgcgtcgaccaagggccccctcggtgaccctctggcccc ttgcagcagaagcaccagcgaatctacagccgccctgggctgcctcgtgaaggactac tttcccgagcccgtgaccgtgtcctggaactctggcgctctgacaagcggcgtgcacac ctttccagccgtgctccagagcagcggcctgtactctctgagcagcgtcgtgacagtgc ccagcagcagcctgggcaccaagacctacacctgtaacgtggaccacaagcccagca acaccaaggtggacaagcgggtggaatctaagtacggccctccctgcccctccttgccc agcccctgaatactgggcggaccctccgtgacctgaccccccaaagcccaaggaca ccctgatgatcagccggacccccgaagtgacctgcgtggtggtgatgtgtcccagga agatcccgaggtgcagttcaattggtacgtggacggcgtggaagtgcacaacgccaa gaccaagcccagagaggaacagttcaacagcacctaccgggtggtgtccgtgctgac cgtgctgcaccaggactggctgaacggcaaagagtacaagtgcaaggtgtccaacaa gggcctgcccagctccatcgagaaaaccatcagcaaggccaagggccagccccgcg agcctcaagtgtataccctgcccccttgccaggaagagatgaccaagaaccaggtgtc cctgtggtgtctcgtgaaaggcttctaccccagcgacattgccgtggaatgggagagca acggccagcccgagaacaactacaagaccaccccctgtgctggacagcgacggc tcattcttcctgtactccaagctgaccgtggacaagagccggtggcaggaaggcaacgt gttcagctgctccgtgatgcacgaggccctgcacaaccactacacccagaagtccctgt ctctgtccctgggcaag | SEQ ID NO: 338 |
| Light chain A | gagatcgtgctgacacagagccctggcaccctgagcctgtctccaggcgagacagcc atcatcagctgccggacaagccagtacggcagcctggcctggtatcagcagaggcct ggacaggcccccagactcgtgatctacagcggcagcacaagagccgccggaatccc cgatagattcagcggctccagatgggggccctgactacaacctgaccatcagcaacctg gaaagcggcgacttcggcgtgtactactgccagcagtacgagacttcggccagggca ccaaggtgcaggtggacatcaagcgtacggtggccgctcccagcgtgttcatcttccca cctagcgacgagcagctgaagtccggcacagcctctgtcgtgtgcctgctgaacaactt ctaccccgcgaggccaaagtgcagtggaaggtggacaacgccctgcagagcggca acagccaggaaagcgtgaccgagcaggacagcaaggactccacctacagcctgagc agcaccctgacactgagcaaggccgactacgagaagcacaaggtgtacgcctgcga agtgacccaccagggcctgtctagccccgtgaccaagagcttcaaccggggcgagtg t | SEQ ID NO: 339 |
| Heavy chain B | caggtgcagctggtgcagtctggcgccgaggtcgtgaaacctggcgcctctgtgaag gtgtcctgcaaggccagcggctacaccttaccagctactacatccactgggtgcgcca ggcccctggacagggactggaatggatcggcagcatctacccccggcaacgtgaacac caactacgcccagaagttccagggcagagccaccctgaccgtggacaccagcatcag caccgcctacatggaactgagccggctgagaagcgacgacaccgccgtgtactactg caccggtcccactacggcctggattgaacttcgacgtgtggggccagggcaccacgc gtgacagtgtctagcagccaggtgcagctggtggaatctggcggcggagtggtgca gcctggcagaagcctgagactgagctgtgccgccagcggcttcaccttcaccaaggc ctggatgcactgggtgcgccaggcccctgaaagcagctggaatgggtggcccagat caaggacaagagcaacagctacgccacctactacgccgacagcgtgaagggccggt tcaccatcagccgggacgacagcaagaacaccctgtacctgcagatgaacagcctgc | SEQ ID NO: 340 |

TABLE 2-continued

Heavy and light chain sequences of binding proteins. CDR sequences are bolded and italicized.

| | | |
|---|---|---|
| | gggccgaggacaccgccgtgtactactgtcggggcgtgtactatgccctgagcccat cgattactggggccagggaaccctcgtgaccgtgtctagtcggaccgccagcacaaa gggcccatcggtgttccctctggcccctttgcagcagaagcaccagcgaatctacagcc gccctgggctgcctcgtgaaggactactacccgagcccgtgaccgtgtcctggaactc tggcgctctgacaagcggcgtgcacacctaccagccgtgctccagagcagcggcctg tactctctgagcagcgtcgtgacagtgcccagcagcagcctgggcaccaagacctaca cctgtaacgtggaccacaagcccagcaacaccaaggtggacaagcgggtggaatcta agtacggccctcctgcctcttgcccagccctgaatactgggcggaccctccgtgt tcctgttcccccaaagcccaaggacaccctgatgatcagccggaccccgaagtgac ctgcgtggtggtggatgtgtcccaggaagatcccgaggtgcagttcaattggtacgtgg acggcgtggaagtgcacaacgccaagaccaagcccagagaggaacagttcaacagc acctaccgggtggtgtccgtgctgaccgtgctgcaccaggactggctgaacggcaaa gagtacaagtgcaaggtgtccaacaagggcctgcccagctccatcgagaaaaccatc agcaaggccaagggccagccccgcgagcctcaagtgtaccctgccccctagcca ggaagagatgaccaagaaccaggtgtccctgagctgtgccgtgaaaggcttctaccc agcgacattgccgtggaatgggagagcaacggccagcccgagaacaactacaagac cacccccctgtgctggacagcgacggctcattcttcctggtgtccaagctgaccgtgg acaagagccgtggcaggaaggcaacgtgacagctgctccgtgatgcacgaggccc tgcacaaccactacacccagaagtccctgtctctgtccctgggcaag | |
| Light chain B | gacatcgtgatgacccagaccccctgagcctgagcgtgacacctggacagcctgcc agcatcagctgcaagagcagccagagcctggtgcacaacaacgccaacacctacctg agctggtatctgcagaagcccggccagagcccccagtccctgatctacaaggtgtcca acagattcagcggcgtgcccgacagattctccggcagcggctctggcaccgacttcac cctgaagatcagccgggtggaagccgaggacgtgggcgtgtactattgtggccaggg cacccagtaccccttcacctaggcagcggcaccaaggtggaaatcaagggccagcc caaggccgccccgacatccagatgacccagagccccagcagcctgtctgccagcgt gggcgacagagtgaccatcacctgtcaggccagccagaacatctacgtgtggctgaa ctggtatcagcagaagcccggcaaggcccccaagctgctgatctacaaggccagcaa cctgcacaccggcgtgcccagcagattactggcagcggctccggcaccgacttcacc ctgacaatcagctccctgcagcccgaggacattgccacctactactgccagcagggcc agacctacccctacacctaggccaggggcaccaagctggaaatcaagaccaagggcc ccagccgtacggtggccgctcccagcgtgacatcttcccacctagcgacgagcagct gaagtccggcacagcctctgtcgtgtgcctgctgaacaacttctaccccgcgaggcc aaagtgcagtggaaggtggacaacgccctgcagagcggcaacagccaggaaagcgt gaccgagcaggacagcaaggactccacctacagcctgagcagcaccctgacactga gcaaggccgactacgagaagcacaaggtgtacgcctgcgaagtgacccaccagggc ctgtctagccccgtgaccaagagcttcaaccggggcgagtgt | SEQ ID NO: 341 |

Binding Protein 37 Amino Acid Sequences

| | | |
|---|---|---|
| Heavy chain A | Qvqlvqsggqmkkpgesmriscrasgyefidctlnwirlapgkrpewmgwlkpr ggavnyarplqgrvtmadvysdtaflelrsltvddtavyfctrgkncdynwdfehw grgtpvivssastkgpsvfplapcsrstsestaalgclvkdyfpepvtvswnsgaltsg vhtfpavlqssglyslssvvtvpssslgtktytcnvdhkpsntkvdkrveskygppcp pcpapeflggpsvflfppkpkdtlmisrtpevtcvvvdvsqedpevqfnwyvdgv evhnaktkpreeqfnstyrvvsvltvlhqdwlngkeykckvsnkglpssiektiska kgqprepqvytlppcqeemtknqvslwclvkgfypsdiavewesngqpennykt tppvldsdgsfflyskltvdksrwqegnvfscsvmhealhnhytqkslslslgk | SEQ ID NO: 342 |
| Light chain A | Eivltqspgtlslspgetaiiscrtsqygslawyqqrpgqaprlviysgstraagipdrfs gsrwgpdynltisnlesgdfgvyycqqyeffgqgtkvqvdikrtvaapsvfifppsd eqlksgtasvvcllnnfypreakvqwkvdnalqsgnsqesvteqdskdstyslsstltl skadyekhkvyacevthqglsspvtksfnrgec | SEQ ID NO: 343 |
| Heavy chain B | Qvqlqesgpglvkpsqtlsltctvsgfslsdygvhwvrqppgkglewlgvi waggggtnynpslksrktiskdtsknqvslklssvtaadtavyycardkgysy yysmdywgqgttvtvsssqvqlvesgggvvqpgrslrlscaasgftftkaw mhwvrqapgkqlewvaqikdksnsyatyyadsvkgrftisrddskntlylq mnslraedtavyycrgvyyalspfdywgqgtlvtvssrtastkgpsvfplapc srstsestaalgclvkdyfpepvtvswnsgaltsgvhtfpavlqssglyslssvv tvpssslgtktytcnvdhkpsntkvdkrveskygppcppcpapeflggpsvf lfppkpkdtlmisrtpevtcvvvdvsqedpevqfnwyvdgvevhnaktktp reeqfnstyrvvsvltvlhqdwlngkeykckvsnkglpssiektiskakgqpr epqvctlppsqeemtknqvslscavkgfypsdiavewesngqpennyktt ppvldsdgsfflvskltvdksrwqegnvfscsvmhealhnhytqkslslslgk | SEQ ID NO: 344 |
| Light chain B | Divmtqtplslsvtpgqpasiscksssqslvhnnantylswylqkpgqspqsliykvs nnrfsgvpdrfsgsgsgtdftlkisrveaedvgvyycgqgtqypftfgsgtkveikgqp kaapdivltqspaslavspgqratitcrasesveyyvtslqwyqqkpgqppkllifa asnvesgvparfsgsgsgtdftltinpveandvanyycqqsrkvpytfgqgtkleikt kgpsrtvaapsvfifppsdeqlksgtasvvcllnnfypreakvqwkvdnalqsgnsq esvteqdskdstyslsstltlskadyekhkvyacevthqglsspvtksfnrgec | SEQ ID NO: 345 |

TABLE 2-continued

Heavy and light chain sequences of binding proteins. CDR sequences are bolded and italicized.

Binding Protein 37 Nucleotide Sequences

| | | |
|---|---|---|
| Heavy chain A | caggtgcagctggtgcagtctggcggccagatgaagaaacccggcgagagcatgcg atcagctgcagagccagcggctacgagttcatcgactgcaccctgaactggatcaga ctggcccctggcaagcggcctgagtggatgggatggctgaagcctagaggcggagc cgtgaactacgccagacctctgcagggcagagtgaccatgacccgggacgtgtacag cgataccgccttcctggaactgcgcgagcctgaccgtggatgataccgccgtgtacttctg cacccggggcaagaactgcgactacaactgggacttcgagcactggggcagaggca cccctgtgatcgtgtcaagcgcgtcgaccaagggccctcggtgaccctctggcccat gcagcagaagcaccagcgaatctacagcgcgcctgggctgcctcgtgaaggactactt tcccgagcccgtgaccgtgtcctggaactctggcgctctgacaagcggcgtgcacacc tttccagccgtgctccagagcagcggcctgtactctctgagcagcgtcgtgacagtgcc cagcagcagcctgggcaccaagacctacacctgtaacgtggaccacaagcccagcaa caccaaggtggacaagcgggtggaatctaagtacgggcctccctgccctccttgccca gcccctgaatactgggcggaccctccgtgacctgaccccccaaagcccaaggacac cctgatgatcagccggaccccggaagtgacctgcgtggtggtggatgtgcccaggaa gatcccgaggtgcagttcaattggtacgtggacggcgtggaagtgcacaacgccaaga ccaagcccagagaggaacagttcaacagcacctaccgggtggtgtccgtgctgaccgt gctgcaccaggactggctgaacggcaaagagtacaagtgcaaggtgtccaacaaggg cctgcccagctccatcgagaaaaccatcagcaaggccaagggccagccccgcgagc ctcaagtgtataccctgccccttgccaggaagagatgaccaagaaccaggtgtccctg tggtgtctcgtgaaaggcttctaccccagcgacattgccgtggaatgggagagcaacg gccagcccgagaacaactacaagaccaccccccctgtgctggacagcgacggctcat tcttcctgtactccaagctgaccgtggacaagagccggtggcaggaaggcaacgtgttc agctgctccgtgatgcacgaggccctgcacaaccactacacccagaagtccctgtctct gtccctgggcaag | SEQ ID NO: 346 |
| Light chain A | Gagatcgtgctgacacagagccctggcacccctgagcctgtctccaggcgagacagcc atcatcagctgccggacaagccagtacggcagcctggcctggtatcagcagaggcctg gacaggcccccagactcgtgatctacagcggcagcacaagagccgccggaatcccc gatagattcagcggctccagatggggccctgactacaacctgaccatcagcaacctgg aaagcggcgacttcggcgtgtactactgccagcagtacgagttcttcggccagggcac caaggtgcaggtggacatcaagcgtacggtggccgctcccagcgtgacatcttcccac ctagcgacgagcagctgaagtccggcacagcctctgtcgtgtgcctgctgaacaacttc taccccgcgaggcaaagtgcagtggaaggtggacaacgccctgcagagcggcaa cagccaggaaagcgtgaccgagcaggacagcaaggactccacctacagcctgagca gcaccctgacactgagcaaggccgactacgagaagcacaaggtgtacgcctgcgaag tgacccaccagggcctgtctagccccgtgaccaagagcttcaaccggggcgagtgt | SEQ ID NO: 347 |
| Heavy chain B | caggtgcagctgcaggaatctggccctggcctcgtgaagcctagccagaccctgagcc tgacctgtaccgtgtccggcttcagcctgagcgactacgccgtgcactgggtgcgcca gccacctggaaaaggcctggaatggctgggcgtgatctgggctggcggaggcaccaa ctacaacccagcctgaagtccagaaagaccatcagcaaggacaccagcaagaacca ggtgtccctgaagctgagcagcgtgacagccgccgataccgccgtgtactactgcgcc agagacaagggctacagctactactacagcatggactactggggccagggcaccacc gtgaccgtgtcatcctctcaggtgcagctggtggaatctggcggcggagtggtgcagc ctggcagaagcctgagactgagctgtgccgccagcggcttcaccttcaccaaggcctg gatgcactgggtgcgccaggcccctggaaagcagctggaatgggtggcccagatcaa ggacaagagcaacagctacgccaccactactacgccgacagcgtgaagggccggttcac catcagccgggacgacagcaagaacacccctgtacctgcagatgaacagcctgcgggc cgaggacaccgccgtgtactactgtcggggcgtgtactatgccctgagccccttcgatta ctggggccagggaaccctcgtgaccgtgtctagtcggaccgcttcgaccaagggccc atcggtgttccctctgcccccttgcagcagaagcaccagcgaatctacagccgccctgg gctgcctcgtgaaggactactaccccgagcccgtgaccgtgtcctggaactctggcgctc tgacaagcggcgtgcacacctaccagccgtgctccagagcagcggcctgtactctctg agcagcgtcgtgacagtgcccagcagcagcctgggcaccaagacctacacctgtaac gtggaccacaagcccagcaacaccaaggtggacaagcgggtggaatctaagtacgg cctcctgccctccttgcccagcccctgaatttctgggcggaccctccgtgttcctgttc cccccaaagcccaaggacaccctgatgatcagccggaccccgaagtgacctgcgtg gtggtggatgtgcccaggaagatcccgaggtgcagttcaattggtacgtggacggcgt ggaagtgcacaacgccaagaccaagcccagagaggaacagttcaacagcacctacc gggtggtgtccgtgctgaccgtgctgcaccaggactggctgaacggcaaagagtacaa gtgcaaggtgtccaacaagggcctgcccagctccatcgagaaaaccatcagcaaggc caagggccagccccgcgagcctcaagtgtataccctgccccctagccaggaagagat gaccaagaaccaggtgtccctgagctgtgccgtgaaaggcttctaccccagcgacattg ccgtggaatgggagagcaacggccagcccgagaacaactacaagaccaccccccct gtgctggacagcgacggctcattcttcctggtgtccaagctgaccgtggacaagagccg gtggcaggaaggcaacgtgttcagctgctccgtgatgcacgaggccctgcacaaccac tacacccagaagtccctgtctctgtccctgggcaag | SEQ ID NO: 348 |
| Light chain B | gacatcgtgatgacccagacccccctgagcctgagcgtgacacctggacagcctgcca tcatcagctgcaagagccccggcagagccccagtccctgatctacaaggtgtccaa cagattcagcggcgtgcccgacagattctccggcagcggctctggcaccgacttcacc ctgaagatcagccgggtggaagccgaggacgtgggcgtgtactattgtggccagggc acccagtaccccttcaccttttggcagcggcaccaaggtggaaatcaagggccagccca aggccgcccccgacatcgtgctgacacagagccctgctagcctggccgtgtctcctgg | SEQ ID NO: 349 |

TABLE 2-continued

Heavy and light chain sequences of binding proteins. CDR sequences are bolded and italicized.

```
acagagggccaccatcacctgtagagccagcgagagcgtggaatattacgtgaccag
cctgatgcagtggtatcagcagaagcccggccagccccccaagctgctgattttcgccg
ccagcaacgtggaaagcggcgtgccagccagattttccggcagcggctctggcaccg
acttcaccctgaccatcaacccccgtggaagccaacgacgtggccaactactactgcca
gcagagccggaaggtgccctacacctttggccagggcaccaagctggaaatcaagac
caagggcccagccgtacggtggccgctcccagcgtgttcatcttcccacctagcgac
gagcagctgaagtccggcacagcctcgtcgtgtgcctgctgaacaacttctacccccg
cgaggccaaagtgcagtggaaggtggacaacgccctgcagagcggcaacagccag
gaaagcgtgaccgagcaggacagcaaggactccacctacagcctgagcagcaccct
gacactgagcaaggccgactacgagaagcacaaggtgtacgcctgcgaagtgaccca
ccaggccctgtctagccccgtgaccaagagcttcaaccggggcgagtgt
```

Binding Protein 38 Amino Acid Sequences

| | | |
|---|---|---|
| Heavy chain A | Qvqlvqsgaevvkpgasvkvsckasgytftsyyihwvrqapgqglewigsiypgnnvntnyaqkfqgratltvdtsistaymelsrlrsddtavyyctrshygldwnfdvwgkgttvtvssastkgpsvfplapcsrstsestaalgclvkdyfpepvtvswnsgaltsgvhtfpavlqssglyslssvvtvpssslgtktytcnvdhkpsntkvdkrveskygppcppcpapeflggpsvflfppkpkdtlmisrtpevtcvvvdvsqedpevqfnwyvdgvevhnaktkpreeqfnstyrvvsvltvlhqdwlngkeykckvsnkglpssiektiskakgqprepqvytlppcqeemtknqvslwclvkgfypsdiavewesngqpennykttppvldsdgsfflyskltvdksrwqegnvfscsvmhealhnhytqkslslslgk | SEQ ID NO: 350 |
| Light chain A | Diqmtqspsslsasvgdrvtltcqasqniyvwlnwyqqkpgkapklliykasnlhtngvpsrfsgsgsgtdftltisslqpediatyycqqgqtypytfgqgtkleikrtvaapsvfifppsdeqlksgtasvvcllnnfypreakvqwkvdnalqsgnsqesvteqdskdstyslsstltlskadyekhkvyacevthqglsspvtksfnrgec | SEQ ID NO: 351 |
| Heavy chain B | Rahlvqsgtamkkpgasvrvscqtsgytftahilfwfrqapgrglewvgwinkpqygavnfgggfrdrvtltrdvyreiaymdirglkpddtavyycardrsygdsswaldawgqgttvvvsasqvqlvesgggvvqpgrslrlscaasgftftkawmhwvrqapgkqlewvaqikdksnsyatyyadsvkgrftisrddsknltlyqmnslraedtavyycrgvyyalspfdywgqgtlvtvssrtastkgpsvfplapcsrstsestaalgclvkdyfpepvtvswnsgaltsgvhtfpavlqssglyslssvvtvpssslgtktytcnvdhkpsntkvdkrveskygppcppcpapeflggpsvflfppkpkdtlmisrtpevtcvvvdvsqedpevqfnwyvdgvevhnaktkpreeqfnstyrvvsvltvlhqdwlngkeykckvsnkglpssiektiskakgqprepqvctlppsqeemtknqvslscavkgfypsdiavewesngqpennykttppvldsdgsfflvskltvdksrwqegnvfscsvmhealhnhytqkslslslgk | SEQ ID NO: 352 |
| Light chain B | Divmtqtplslsvtpgqpasisckssqslvhnnantylswylqkpgqspqsliykvsnrfsgvpdrfsgsgsgtdftlkisrveaedvgvyycgqgtqypftfgsgtkveikgqpkaapyihvtqspsslsvsigdrvtincqtsqgvgsdlhwyqhkpgrapkllihhtssvedgvpsrfsgsgfhtsfnltisdlqaddiatyycqvlqffgrgsrlhiktkgpsrtvaapsvfifppsdeqlksgtasvvcllnnfypreakvqwkvdnalqsgnsqesvteqdskdstyslsstltlskadyekhkvyacevthqglsspvtksfnrgec | SEQ ID NO: 353 |

Binding Protein 38 Nucleotide Sequences

| | | |
|---|---|---|
| Heavy chain A | caggtgcagctggtgcagtctggcgccgaggtcgtgaaacctggcgcctctgtgaaggtgtcctgcaaggccagcggctacaccataccagctactacatccactgggtgcgccaggcccctggacagggactggaatggatcggcagcatctaccccggcaacgtgaacaccaactacgcccagaagaccaggcgcagagccaccctgaccgtggacaccagcatcagcaccgcctacatggaactgagccggctgagaagcgacgacaccgcgtgtactactgcaccggtcccactacggcctggattggaacttcgacgtgtggggcaagggcaccaccgtgacagtgtctagcgcgtcgaccaagggcccctcggtgaccctctggccccttgcagcagaagcaccagcgaatctacagccgcccctgggctgcctcgtgaaggactactaccgagcccgtgaccgtgtcctggaactctggcgctctgacaagcggcgtgcacacctaccagcgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggcccctcctgcctcttgcccagcccctgaatactgggcggaccctcgtgacctgacccccaaagcccaaggacaccctgatgatcagccggaccccgaagtgacctgcgtggtggtggatgtgtcccaggaagatccgaggtgcagttcaattggtacgtggacggcgtggaagtgcacaacgccaagacaagcccagagaggaacagacaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgccccttgccaggaagagatgaccaagaaccaggtgtccctgtggtgtctcgtgaaggcttctacccccagcgacattgccgtggaatggagagcaacgcccagaacaactacaagaccaccccccctgtgctggacagcgacggctcattcttcctgtactccaagctgaccgtggacaagagccggtggcaggaaggcaacgtgacagctgctccgtgatgcacgaggccctgcacaaccactacacccagaagtccctgtctctgtccctgggcaag | SEQ ID NO: 354 |

TABLE 2-continued

Heavy and light chain sequences of binding proteins. CDR sequences are bolded and italicized.

| | | |
|---|---|---|
| Light chain A | Gacatccagatgacccagagccccagcagcctgtctgccgcgtgggcgacagagt gaccatcacctgtcaggccagccagaacatctacgtgtggctgaactggtatcagcaga agcccggcaaggcccccaagctgctgatctacaaggccagcaacctgcacaccggc gtgcccagcagattactggcagcggctccggcaccgacttcaccctgacaatcagctc cctgcagcccgaggacattgccacctactactgccagcagggccagacctacccctac acctaggccagggcaccaagctggaaatcaagcgtacggtggccgctcccagcgtgt tcatcttcccacctagcgacgagcagctgaagtccggcacagcctctgtcgtgtgcctg ctgaacaacttctaccccgcgaggccaaggtgcagtggaaggtggacaatgccctgc agagcggcaacagccaggaaagcgtgaccgagcaggacagcaaggactccaccta cagcctgagcagcaccctgaccctgagcaaggccgactacgagaagcacaaggtgta cgcctgcgaagtgacccaccagggcctgtctagccccgtgaccaagagcttcaaccg gggcgagtgt | SEQ ID NO: 355 |
| Heavy chain B | agagcccacctggtgcagtctggcaccgccatgaagaaaccaggcgcctctgtgcgg tgtcctgtcagacaagcggctacaccttcaccgcccacatcctgactggaccggcag gcccctggcagaggactggaatgggtgggatggatcaagcccagtatggcgccgtg aacttcggcggaggcttccgggatagagtgaccctgaccccgggacgtgtaccgcgag atcgcctacatggacatccggggcctgaagcccgatgacaccgccgtgtactactgcg ccagagacagaagctacgcgacagcagctgggctctggatgcttggggccaggc acaaccgtggtggtgtctgcctctcaggtgcagctggtggaatctggcggcggagtggt gcagcctggcagaagcctgagactgagctgtgccgccagcggcttcaccttcaccaag gcctggatgcactgggtgcgccaggcccctggaaagcagctggaatgggtggcccga atcaaggacaagagcaacagctacgccacctactacgccagcgtgaagggccg gttcaccatcagccgggacgacagcaagaacaccctgtacctgcagatgaacagcctg cggggccgaggacaccgccgtgtactactgtcggggcgtgtactatgccctgagcccctt cgattactggggccagggaaaccctcgtgaccgtgtctagtcggaccgcttcgaccaag ggcccatcggtgttccctctggccctgcagcagaagcaccagcgaatctacagcg cctgggctgcctcgtgaaggactactttcccgagcccgtgaccgtgtcctggaactctg gcgctctgacaagcggcgtgcacacctttccagccgtgctccagagcagcggcctgta ctctctgagcagcgtcgtgacagtgcccagcagcagcctgggcaccaagacctacacc tgtaacgtggaccacaagcccagcaacaccaaggtggacaagcgggtggaatctaag tacggccctccctgcctccttgcccagccctgaatactgggcggaccctccgtgac ctgttccccccaaagcccaaggacaccctgatgatcagccggacccccgaagtgacct gcgtggtggtggatgtgtcccaggaagatcccgaggtgcagttcaattggtacgtggac ggcgtggaagtgcacaacgccaagaccaagcccagagaggaacagttcaacagcac ctaccgggtggtgtccgtgctgaccgtgctgcaccaggactggctgaacggcaaagag tacaagtgcaaggtgtccaacaagggcctgcccagctccatgagaaaaccatcagca aggccaagggccagcccgcgagcctcaagtgtgtaccctgccccctagccaggaag agatgaccaagaaccaggtgtccctgagctgtgccgtgaaaggcttctaccccagcga cattgccgtggaatgggagagcaacggccagcccgagaacaactacaagaccaccc ccctgtgctggacagcgacggctcattcttcctggtgtccaagctgaccgtggacaag agccggtggcaggaaggcaacgtgttcagctgctccgtgatgcacgaggccctgcac aaccactacacccagaagtccctgtctctgtccctgggcaag | SEQ ID NO: 356 |
| Light chain B | Gacatcgtgatgacccagacccccctgagcctgagcgtgacacctggacagcctgcc agcatcagctgcaagagcagccagagcctggtgcacaacaacgccaacacctacctg agctggtatctgcagaagcccggccagagcccccagtccctgatctacaaggtgtcca acagattcagcggcgtgcccgacagattctccggcagcggctctggccagaccttcac cctgaagatcagccgggtggaagccgaggacgtgggcgtgtactattgtggccaggg cacccagtaccccttcaccttggcagcggcaccaaggtggaaatcaagggccagccc aaggccgcccctacatccacgtgacccagagccccagcagcctgtccgtgtccatcg gcgacagagtgaccatcaactgccagacctctcagggcgtgggcagcgacctgcact ggtatcagcacaagcctggcagagcccccaagctgctgatcaccacacaagcagcg tggaagatggcgtgcccagcagattttccggcagcggcttccacaccagcttcaacctg accatcagcgatctgcaggccgacgacattgccacctactattgtcaggtgctgcagttc ttcggcagaggcagcagactgcacatcaagaccaagggcccccagccgtacggtggc cgctcccagcgtgttcatcttcccacctagcgacgagcagctgaagtccggcacagcct ctgtcgtgtgcctgctgaacaacttctaccccgcgaggccaaagtgcagtggaaggtg gacaacgccctgcagagcggcaacagccaggaaagcgtgaccgagcaggacagca aggactccacctacagcctgagcagcaccctgaccctgagcaaggccgactacgaga gcacaaggtgtacgcctgcgaagtgacccaccagggcctgtctagccccgtgacca agagcttcaaccggggcgagtgt | SEQ ID NO: 357 |

Binding Protein 39 Amino Acid Sequences

| | | |
|---|---|---|
| Heavy chain A | Qvqlvqsgaevvkpgasvkvsckasgytftsyyihwvrqapgqglewigsiypgn invntnyaqkfqgratltvdtsistaymelsrlrsddtavyyctrshygldwnfdvwgkg ttvtvssastkgpsvflapcsrstsestaalgclvkdyfpepvtvswnsgaltsgvhtf pavlqssglyslssvvtvpssslgtktytcnvdhkpsntkvdkrveskygppcpppcp apeflggpsvflfppkpkdtlmisrtpevtcvvvdvsqedpevqfnwydgvevh naktkpreeqfnstyrvvsvltvlhqdwlngkeykckvsnkglpssiektiskakgq prepqvytlppcqeemtknqvslwclvkgfypsdiavewesngqpennykttpp vldsdgsfflysklvtdksrwqegnvfscsvmhealhnhytqkslslslgk | SEQ ID NO: 358 |

TABLE 2-continued

Heavy and light chain sequences of binding proteins. CDR sequences are bolded and italicized.

| | | |
|---|---|---|
| Light chain A | Diqmtqspsslsasvgdrvtltcqasqniyvwlnwyqqkpgkapklliykasnlht gvpsrfsgsgsgtdftltisslqpediatyycqqgqtypytfgqgtkleikrtvaapsvfi fppsdeqlksgtasvvcllnnfypreakvqwkvdnalqsgnsqesvteqdskdstys lsstltlskadyekhkvyacevthqglsspvtksfnrgec | SEQ ID NO: 359 |
| Heavy chain B | Rahlvqsgtamkkpgasvrvscqtsgytftahilfwfrqapgrglewvgwi nkpqygavnfgggfrdrvtltrdvyreiaymdirglkpddtavyycardrsyg dsswaldawgqgttvvvsasqvqlvesgggvvqpgrslrlscaasgftf tkawmhwvrqapgkqlewvaqikdksnsyatyyadsvkgrftisrddskn tlylqmnslraedtavyycrgvyyalspfdywgqgtlvtvssrtastkgp svfplapcsrstsestaalgclvkdyfpepvtvswnsgaltsgvhtfpavlqss glyslssvvtvpssslgtktytcnvdhkpsntkvdkrveskygppcppcpap eflggpsvflfppkpkdtlmisrtpevtcvvvdvsqedpevqfnwyvdgve vhnaktkpreeqfnstyrvvsvltvlhqdwlngkeykckvsnkglpssiekti skakgqprepqvctlppsqeemtknqvslscavkgfypsdiavewesngq pennykttppvldsdgsfflvskltvdksrwqegnvfscsvmhealhnhytq kslslslgk | SEQ ID NO: 360 |
| Light chain B | Divmtqtplslsvtpgqpasisckssqslvhnnantylswylqkpgqspqsliykvs nnrfsgvpdrfsgsgsgtdftlkisrveaedvgvyycqqgtqypftfgsgtkveikdkth tyihvtqspsslsvsigdrvtincqtsqgvgsdlhwyqhkpgrapkllihhtssvedg vpsrfsgsgfhtsfnltisdlqaddiatyycqvlqffgrgsrlhikktkgpsrtvaapsvfif ppsdeqlksgtasvvcllnnfypreakvqwkvdnalqsgnsqesvteqdskdstysl sstltlskadyekhkvyacevthqglsspvtksfnrgec | SEQ ID NO: 361 |

Binding Protein 39 Nucleotide Sequences

| | | |
|---|---|---|
| Heavy chain A | caggtgcagctggtgcagtctggcgccgaggtcgtgaaacctggcgcctctgtgaagg tgtcctgcaaggccagcggctacacctttaccagctactacatccactgggtgcgcag gcccctggacagggactggaatggatcggcagcatctaccccggcaacgtgaacacc aactacgcccagaagttccagggcagagccaccctgacggtggacaccagcatcagc accgcctacatggaactgagccggctgagaagcgacgacaccgccgtgtactactgc accggtcccactacggcctggattggaacttcgacgtgtggggcaagggcaccacc gtgacagtgtctagcgcgtcgaccaagggcccctcggtgttccctctggccccttgcag cagaagcaccagcgaatctacagccgccctgggctgcctcgtgaaggactactttccc gagcccgtgaccgtgtcctggaactctggcgctctgacaagcggcgtgcacacctttcc agccgtgctccagagcagcggcctgtactctctgagcagcgtcgtgacagtgcccagc agcagcctgggcaccaagacctacacctgtaacgtggaccacaagcccagcaacacc aaggtggacaagcgggtggaatctaagtacggcccctccctgcctcccttgcccagcc ctgaatttctgggcggaccctccgtgttcctgttccccccaaagcccaaggacaccctga tgatcagccggaccccccgaagtgacctgcgtggtggtggatgtgtcccaggaagatcc cgaggtgcagttcaattggtacgtggacggcgtggaagtgcacaacgccaagaccaa gccccagagaggaacagttcaacagcacctacccgggtggtgtccgtgctgaccgtgctg caccaggactggctgaacggcaaagagtacaagtgcaaggtgtccaacaagggcctg cccagctccatcgagaaaaccatcagcaaggccaagggccagccccgcgagcctca agtgtataccctgcccccttgccaggaagagatgaccaagaaccaggtgtccctgtggt gtctcgtgaaaggcttctaccccagcgacattgccgtggaatgggagagcaacgcca gcccgagaacaactacaagaccacccccccctgtgctggacagcgacggctcattcttc ctgtactccaagctgaccgtggacaagagccggtggcaggaaggcaacgtgttcagct gctccgtgatgcacgaggccctgcacaaccactacacccagaagtccctgtctctgtcc ctgggcaag | SEQ ID NO: 362 |
| Light chain A | gacatccagatgacccagagccccagcagcctgtctgccagcgtgggcgacagagtg accatcacctgtcaggccagcagaacatctacgtgtggctgaactggtatcagcagaa gcccggcaaggcccccaagctgctgatctacaaggccagcaacctgcacaccggcgt gcccagcagatttctggcagcggctccggcaccgacttcaccctgacaatcagctccc tgcagcccgaggacattgccacctactactgccagcagggccagaccacccctacac ctttggccagggcaccaagctggaaatcaagcgtacggtggccgctcccagcgtgttc atcttcccacctagcgacgagcagctgaagtccggcacagccctctgtcgtgtgcctgct gaacaacttctaccccgcgaggccaaggtgcagtggaaggtggacaatgccctgca gagcggcaacagccaggaaagcgtgaccgagcaggacagcaaggactccaccta cagcctgagcagcaccctgaccctgagcaaggccgactacgagaagcacaaggtgta cgcctgcgaagtgacccaccagggcctgtctagccccgtgaccaagagcttcaaccgg ggcgagtgt | SEQ ID NO: 363 |
| Heavy chain B | agagcccacctggtgcagtctggcaccgccatgaagaaaccaggcgcctctgtgcgg gtgtcctgtcagacaagcggctacacctttaccgcccacatcctgactggaccggcag gcccctggacagaggactggaatgggtgggatggatcaagcccccagtatggcgccgtg aacttcggcggaggcttccgggatagagtgaccctgaccgggacgtgtaccgcgag atcgcctacatggacatccgggggcctgaagcccgatgacaccgccgtgtactactgcg ccagagacgaaagctacggcgacagcagctgggctctggatgcttggggccagggc acaaccgtggtgtctgccgacaaaacccatacccaggtgcagctggtggaatctg gcgggagtggtgcagcctggcagaagcctgagactgagctgtgccgccagcggc ttcaccttcaccaaggcctggatgcactgggtgcgccaggcccctggaaagcagctgg aatgggtggcccagatcaaggacaagagcaacagctacgccacctactacgccgaca gcgtgaagggccggttcaccatcagccgggacgacagcaagaacaccctgtacctgc agatgaacagcctgcgggccgaggacaccgccgtgtactactgtcggggcgtgtacta | SEQ ID NO: 364 |

TABLE 2-continued

Heavy and light chain sequences of binding proteins. CDR sequences are bolded and italicized.

| | | |
|---|---|---|
| | tgccctgagccccttcgattactggggccagggaaccctcgtgaccgtgtctagtgataa gaccccacaccgcttcgaccaagggcccatcggtgttccctctggccccttgcagcaga agcaccagcgaatctacagccgccctgggctgcctcgtgaaggactactttcccgagc ccgtgaccgtgtcctggaactctggcgctctgacaagcggcgtgcacacctttccagcc gtgctccagagcagcggcctgtactctctgagcagcgtcgtgacagtgcccagcagca gcctgggcaccaagacctacacctgtaacgtggaccacaagcccagcaacaccaagg tggacaagcgggtggaatctaagtacggccctccctgccctccttgcccagcccctgaa tttctgggcggaccctccgtgttcctgttcccccaaagcccaaggacaccctgatgatc agccggaccccgaagtgacctgcgtggtggtggatgtgcccaggaagatcccgag gtgcagttcaattggtacgtggacggcgtggaagtgcacaacgccaagaccaagccca gagaggaacagttcaacagcacctaccgggtggtgtccgtgctgaccgtgctgcacca ggactggctgaacggcaaagagtacaagtgcaaggtgtccaacaagggcctgcccag ctccatcgagaaaaccatcagcaaggccaagggccagccccgcgagcctcaagtgtg tacccctgcccctagccaggaagagatgaccaagaaccaggtgtccctgagctgtgcc gtgaaaggcttctaccccagcgacattgccgtggaatgggagagcaacggccagccc gagaacaactacaagaccaccccccctgtgctggacagcgacggctcattcttcctggt gtccaagctgaccgtggacaagagccggtggcaggaaggcaacgtgttcagctgctc cgtgatgcacgaggccctgcacaaccactacacccagaagtccctgtctctgtccctgg gcaag | |
| Light chain B | gacatcgtgatgacccagacccccctgagcctgagcgtgacacctggacagcctgcca catcagctgcaagagcagccagagcctggtgcacaacaacgccaacacctacctga gctggtatctgcagaagcccggccagagccccagtccctgatctacaaggtgtccaa cagattcagcggcgtgcccgacagattctccggcagcggctctggcaccgacttcacc ctgaagatcagccgggtggaagccgaggacgtgggcgtgtactattgtggccagggc acccagtacccccttcacctttggcagcggcaccaaggtggaaatcaaggacaaaacc ataacctacatccacgtgacccagagccccagcagcctgtccgtgtccatcggcgacag agtgaccatcaactgccagacctctcagggcgtgggcagcgacctgcactggtatcag cacaagcctggcagagccccaagctgctgatccaccacaagcagcgtggaagat ggcgtgccccagcagattttccggcagcggcttccacaccagcttcaacctgaccatcag cgatctgcaggccgacgacattgccacctactattgtcaggtgctgcagttcttcggcag aggcagcagactgcacatcaaggataagacccataccgtacggtggccgctcccag cgtgttcatcttcccacctagcgacgagcagctgaagtccggcacagcctctgtcgtgtg cctgctgaacaacttctaccccgcgaggccaaagtgcagtggaaggtggacaacgc cctgcagagcggcaacagccaggaaagcgtgaccgagcaggacaagaagactcc acctacagcctgagcagcaccctgacactgagcaaggccgactacgagaagcacaag gtgtacgcctgcgaagtgacccaccagggcctgtctagccccgtgaccaagagcttca accggggcgagtgt | SEQ ID NO: 365 |

Binding Protein 40 Amino Acid Sequences

| | | |
|---|---|---|
| Heavy chain A | Qvqlvqsgaevvkpgasvkvsckasgytftsyyihwvrqapgqglewigsiypg nvntnyaqkfqgratltvdtsistaymelsrlrsddtavyyctrshygldwnfdvwgk gttvtvssastkgpsvfplapcsrstsestaalgclvkdyfpepvtvswnsgaltsgvht fpavlqssglyslssvvtvpssslgtktytcnvdhkpsntkvdkrveskygppcppc papeflggpsvflfppkpkdtlmisrtpevtcvvvdvsqedpevqfnwyvdgvev hnaktkpreeqfnstyrvvsvltvlhqdwlngkeykckvsnkglpssiektiskakg qprepqvytlppcqeemtknqvslwclvkgfypsdiavewesngqpennykttp pvldsdgsfflyskltvdksrwqegnvfscsvmhealhnhytqkslslslgk | SEQ ID NO: 366 |
| Light chain A | Diqmtqspsslsasvgdrvtltcqasqniyvwlnwyqqkpgkapklliykasnlht gvpsrfsgsgsgtdftltisslqpediatyycqqgqtypytfgqgtkleikrtvaapsvfi fppsdeqlksgtasvvcllnnfypreakvqwkvdnalqsgnsqesvteqdskdsty slsstltlskadyekhkvyacevthqglsspvtksfnrgec | SEQ ID NO: 367 |
| Heavy chain B | Qvqlvesgggyvqpgrslrlscaasgftftkawmhwyrqapgkqlewva nqikdksnsyatyyadsvkgrftisrddskntlylqmnslraedtavyycrgvy yalspfdywgqgtlytysssrahlyqsgtamkkpgasvrvscqtsgytftahi lfwfrqapgrglewygwikpqygavnfgggfrdrytltrdyyreiaymdirg lkpddtavyycardrsygdsswaldawgqgttyvvsartastkgpsvfplap csrstsestaalgclykdyfpepytyswnsgaltsgyhtfpavlqssglyslssv vtvpssslgtktytcnvdhkpsntkvdkrveskygppcpppcpapeflggps vflfppkpkdtlmisrtpevtcyvvdvsqedpevqfnwyydgvevhnakt kpreeqfnstyrvvsvltvlhqdwlngkeykckvsnkglpssiektiskakg qprepqvctlppsqeemtknqvslscavkgfypsdiavewesngqpenny kttppvldsdgsfflvskltvdksrwqegnvfscsvmhealhnhytqkslsls lgk | SEQ ID NO: 368 |
| Light chain B | Yihvtqspsslsvsigdrvtincqtsqgvgsdlhwyqhkpgrapkllihhtssvedg vpsrfsgsgfhtsfnltisdlqaddiatyycqvlqffgrgsrlhikgqpkaapdivmtqt plslsvtpgqpasiscksssqslvhnnantylswylqkpgqspqsliykvsnrfsgvpd rfsgsgsgdftlkisrveaedvgvyycgqgtqypftfgsgtkveiktkgpsrtvaaps vfifppsdeqlksgtaswcllnnfypreakvqwkvdnalqsgnsqesvteqdskds tyslsstltlskadyekhkvyacevthqglsspvtksfnrgec | SEQ ID NO: 369 |

TABLE 2-continued

Heavy and light chain sequences of binding proteins. CDR sequences are bolded and italicized.

| Binding Protein 40 Nucleotide Sequences | | |
|---|---|---|
| Heavy chain A | caggtgcagctggtgcagtctggcgccgaggtcgtgaaacctggcgcctctgtgaagg tgtcctgcaaggccagcggctacacctttaccagctactacatccactgggtgcgcag gcccctggacagggactggaatggatcggcagcatctaccccggcaacgtgaacacc aactacgcccagaagttccagggcagagccaccctgaccgtggacaccagcatcagc accgcctacatggaactgagccggctgagaagcgacgacaccgccgtgtactactgc acccggtcccactacggcctggattggaacttcgacgtgtggggccaagggcaccacc gtgacagtgtctagcgcgtcgaccaagggcccctcggtgttcctctggcccttgcag cagaagcaccagcgaatctacagccgccctgggctgcctcgtgaaggactactttccc gagcccgtgaccgtgtcctggaactctggcgctctgacaagcggcgtgcacacctttcc agccgtgctccagagcagcggcctgtactctctgagcagcgtcgtgacagtgcccagc agcagcctgggcaccaagacctacacctgtaacgtggaccacaagcccagcaacacc aaggtggacaagcgggtggaatctaagtacggccctccctgccctccttgcccagccc ctgaatttctgggcggaccctccgtgttcctgttccccccaaagcccaaggacaccctga tgatcagccggaccccccgaagtgacctgcgtggtggtggatgtgtcccaggaagatcc cgaggtgcagttcaattggtacgtggacggcgtggaagtgcacaacgccaagaccaa gcccagagaggaacagttcaacagcacctaccgggtggtgtccgtgctgaccgtgctg caccaggactggctgaacggcaaagagtacaagtgcaaggtgtccaacaagggcctg cccagctccatcgagaaaaccatcagcaaggccaagggccagccccgcgagcctca agtgtataccctgccccctgccaggaagagatgaccaagaaccaggtgtccctgtggt gtctcgtgaaaggcttctaccccagcgacattgccgtggaatgggagagcaacgcca gcccgagaacaactacaagaccacccccctgtgctggacagcgacggctcattcttc ctgtactccaagctgaccgtggacaagagccggtggcaggaaggcaacgtgttcagct gctccgtgatgcacgaggccctgcacaaccactacacccagaagtccctgtctctgtcc ctgggcaag | SEQ ID NO: 370 |
| Light chain A | gacatccagatgacccagagccccagcagcctgtctgccagcgtgggcgacagagtg accatcacctgtcaggccagcagaacatctacgtgtggctgaactggtatcagcagaa gcccggcaaggcccccaagctgctgatctacaaggccagcaacctgcacaccggcgt gcccagcagattttctggcagcggctccggcaccgacttcaccctgacaatcagctccc tgcagcccgaggacattgccacctactactgccagcagggccagacctaccctacac ctttggccagggcaccaagctggaaatcaagcgtacggtggccgctcccagcgtgttc atcttcccacctagcgacgagcagctgaagtccggcacagcctctgtcgtgtgcctgct gaacaacttctaccccgcgaggccaaggtgcagtggaaggtggacaatgccctgca gagcggcaacagccaggaaagcgtgaccgagcaggacagcaaggactccacctac agcctgagcagcaccctgaccctgagcaaggccgactacgagaagcacaaggtgtac gcctgcgaagtgacccaccagggcctgtctagccccgtgaccaagagcttcaaccgg ggcgagtgt | SEQ ID NO: 371 |
| Heavy chain B | caggtgcagctggtggaatctggcggcggagtggtgcagcctggcagaagcctgaga ctgagctgtgccgcagcggcttcaccttcaccaaggcctggatgcactgggtgcgcc aggcccctggaaagcagctggaatgggtggcccagatcaaggacaagagcaacagc tacgccacctactacgccgacagcgtgaagggccggttcaccatcagccgggacgac agcaagaacaccctgtacctgcagatgaacagcctgcgggccgaggacaccgccgtg tactactgtcggggcgtgtactatgccctgagccccttcgattactggggccagggaac cctcgtgaccgtgtctagtagcagagcccacctggtgcagtctgccagcatgaag aaaccaggcgcctctgtgcgggtgtcctgtcagacaagcggctacaccttcaccgcc acatcctgttctggttccggcaggcccctggcagaggactggaatgggtgggatggat caagcccagtatggcgccgtgaacttcggcggaggcttccgggatagagtgaccctg acccgggacgtgtaccgcgagatcgcctacatggacatccggggcctgaagcccgat gacaccgccgtgtactactgcgccagagacagaagctacggcgacagcagctgggct ctggatgcttggggccagggcacaaccgtggtggtgtctgccccggaccgccagcaca aagggccatcggtgttccctctggccccttgcagcagaagcaccagcgaatctacag ccgccctgggctgcctcgtgaaggactactacccgagcccgtgaccgtgtcctggaac tctggcgctctgacaagcggcgtgcacacctttccagccgtgctccagagcagcggcc tgtactctctgagcagcgtcgtgacagtgcccagcagcagcctgggcaccaagaccta cacctgtaacgtggaccacaagcccagcaacaccaaggtggacaagcgggtggaatc taagtacggccctccctgccctccttgcccagcccctgaatactgggcggaccctccgt gttcctgttccccccaaagcccaaggacaccctgatgatcagccggacccccgaagtg acctgcgtggtggtggatgtgtcccaggaagatcccgaggtgcagttcaattggtacgt ggacggcgtggaagtgcacaacgccaagaccaagcccagagaggaacagttcaaca gcacctaccgggtggtgtccgtgctgaccgtgctgcaccaggactggctgaacggcaa agagtcaaggtgtcaacaagggctgcccagctccatcgagaaaaccatc agcaaggccaagggccagccccgcgagcctcaagtgtataccctgccccctagccag gaagagatgaccaagaaccaggtgtccctgagctgtgccgtgaaaggcttctacccca gcgacattgccgtgaatgggagagcaacggccagcccgagaacaactacaagacc acccccctgtgctggacagcgacggctcattcttcctggtgtccaagctgaccgtgga caagagccggtggcaggaaggcaacgtgttcagctgctccgtgatgcacgaggccct gcacaaccactacacccagaagtccctgtctctgtccctgggcaag | SEQ ID NO: 372 |
| Light chain B | ttacatccacgtgacccagagccccagcagcctgtccgtgtccatcggcgacag agtgaccatcaactgccagacctctcagggcgtgggcagcgacctgcactggt atcagcacaagcctggcagagcccccaagctgctgatccaccacaagcag cgtggaagatggcgtgcccagcagattttccggcagcggcttccacaccagctt caacctgaccatcagcgatctgcaggccgacgacattgccacctactattgtca ggtgctgcagttcttcggcagaggcagcagactgcacatcaagggccagccca | SEQ ID NO: 373 |

TABLE 2-continued

Heavy and light chain sequences of binding proteins. CDR sequences are bolded and italicized.

```
aggccgcccccgacatcgtgatgacccagacccccctgagcctgagcgtgac
acctggacagcctgccagcatcagctgcaagagcagccagagcctggtgcac
aacaacgccaacacctacctgagctggtatctgcagaagcccggccagagcc
cccagtccctgatctacaaggtgtccaacagattcagcggcgtgcccgacagat
tctccggcagcggctctggcaccgacttcaccctgaagatcagccgggtggaa
gccgaggacgtgggcgtgtactattgtgccagggcacccagtacccccttcac
ctttggcagcggcaccaaggtggaaatcaagaccaagggccccagccgtacg
gtggccgctcccagcgtgttcatcttcccacctagcgacgagcagctgaagtcc
ggcacagcctctgtcgtgtgcctgctgaacaacttctaccccgcgaggccaaa
gtgcagtggaaggtggacaacgccctgcagagcggcaacagccaggaaagc
gtgaccgagcaggacagcaaggactccacctacagcctgagcagcaccctga
cactgagcaaggccgactacgagaagcacaaggtgtacgcctgcgaagtgac
ccaccagggcctgtctagccccgtgaccaagagatcaaccggggcgagtgt
```

Binding Protein 41 Amino Acid Sequences

| | | |
|---|---|---|
| Heavy chain A | Qvqlvqsgaevvkpgasvkvsckasgytftsyyihwvrqapgqglewigsiypgn ntnyaqkfqgratltvdtsistaymelsrlrsddtavyyctrshygldwnfdvwkg ttvtvssastkgpsvfplapcsrstsestaalgclvkdyfpepvtvswnsgaltsgvhtf pavlqssglyslssvvtvpssslgtktytcnvdhkpsntkvdkrveskygppcppcp apeflggpsvflfppkpkdtlmisrtpevtcvvvdvsqedpevqfnwyvdgvevh naktkpreeqfnstyrvvsvltvlhqdwlngkeykckvsnkglpssiektiskakgq prepqvytlppcqeemtknqvslwclvkgfypsdiavewesngqpennykttpp vldsdgsfflysklvtdksrwqegnvfscsvmhealhnhytqkslslslgk | SEQ ID NO: 374 |
| Light chain A | Diqmtqspsslsasvgdrvtltcqasqniyvwlnwyqqkpgkapklliykasnlht ingvpsrfsgsgsgtdftltisslqpediatyycqqgqtypytfgqgtkleikrtvaapsvfi fppsdeqlksgtasvvcllnnfypreakvqwkvdnalqsgnsqesvteqdskdstys lssstltlskadyekhkvyacevthqglsspvtksfnrgec | SEQ ID NO: 375 |
| Heavy chain B | Qvqlvesggggyvqpgrslrlscaasgftftkawmhwyrqapgkqlewvaq ikdksnsyatyyadsvkgrftisrddskntlylqmnslraedtavyycrgvyy alspfdywgqgtlytysssrahlyqsgtamkkpgasvrvscqtsgytft ahilfwfrqapgrglewygwikpqygavnfgggfrdrvtltrdvyreiaym dirglkpddtavyycardrsygdsswaldawgqgttvvvsartastkgp svfplapcsrstsestaalgclykdyfpepytyswnsgaltsgyhtfpavlqss glyslssvvtvpssslgtktytcnvdhkpsntkvdkrveskygppcppcpap eflggpsvflfppkpkdtlmisrtpevtcyvvdvsqedpevqfnwyydgve vhnaktkpreeqfnstyrvvsvltvlhqdwlngkeykckvsnkglpssiekti skakgqprepqvctlppsqeemtknqvslscavkgfypsdiavewesngq pennykttppvldsdgsfflvskltvdksrwqegnvfscsvmhealhnhytq kslslslgk | SEQ ID NO: 376 |
| Light chain B | Yihvtqspsslsvsigdrvtincqtsqgvgsdlhwyqhkpgrapkllihhtssvedg nvpsrfsgsgfhtsfnltisdlqaddiatyycqvlqffgrgsrlhikdkthtdivmtqtplsl svtpgqpasiscksssqslvhnnantylswylqkpgqspqsliykvsnrfsgvpdrfs gsgsgtdftlkisrveaedvgvyycqgqtqypftfgsgtkveikdkthtrtvaapsvfif ppsdeqlksgtasvvcllnnfypreakvqwkvdnalqsgnsqesvteqdskdstysl sstltlskadyekhkvyacevthqglsspvtksfnrgec | SEQ ID NO: 377 |

Binding Protein 41 Nucleotide Sequences

| | | |
|---|---|---|
| Heavy chain A | caggtgcagctggtgcagtctggcgccgaggcgtgaaacctggcgcctctgtgaagg tgtcctgcaaggccagcggctacacctttaccagctactacatccactgggtgcgccag gcccctggacagggactggaatggatcggcagcatctaccccggcaacgtgaacacc aactacgcccagaagttccagggcagagccaccctgaccgtggacaccagcatcagc accgcctacatggaactgagccggctgagaagcgacgacaccgccgtgtactactgc acccggtcccactacggcctggattggaacttcgacgtgtggggcaagggcaccacc gtgacagtgtctagcgcgtcgaccaagggccctcggtgttccctctggccccttgcag cagaagcaccagcgaatctacagccgccctgggctgcctcgtgaaggactactttccc gagcccgtgaccgtgtcctggaactctggcgctctgacaagcggcgtgcacacctttcc agccgtgctccagagcagcggcctgtactctctgagcagcgtcgtgacagtgcccagc agcagcctgggcaccaagacctacacctgtaacgtggaccacaagcccagcaacacc aaggtggacaagcgggtggaatctaagtacggccctcctgccctccttgcccagccc ctgaatttctgggcggaccctccgtgttcctgttcccccaaagcccaaggacaccctga tgatcagccggaccccgaagtgacctgcgtggtggtggatgtgtcccaggaagatcc cgaggtgcagttcaattggtacgtggacggcgtggaagtgcacaacgccaagaccaa gcccagagaggaacagttcaacagcacctaccgggtggtgtccgtgctgaccgtgctg caccaggactggctgaacggcaaagagtacaagtgcaaggtgtccaacaagggcctg cccagctccatcgagaaaaccatcagcaaggccaagggccagccccgcgagcctca agtgtataccctgcccccttgccaggaagagatgaccaagaaccaggtgtccctgtggt gtctcgtgaaggcttctaccccagcgacattgccgtggaatgggagagcaacggcca gcccgagaacaactacaagaccaccccccctgctgctggacagcgacggctcattcttc ctgtactccaagctgaccgtggacaagagccggtggcaggaaggcaacgtgttcagct gctccgtgatgcacgaggccctgcacaaccactacacccagaagtccctgtctctgtcc ctgggcaag | SEQ ID NO: 378 |

TABLE 2-continued

Heavy and light chain sequences of binding proteins. CDR sequences are bolded and italicized.

| | | |
|---|---|---|
| Light chain A | gacatccagatgacccagagccccagcagcctgtctgcagcgtgggcgacagagtg accatcacctgtcaggccagccagaacatctacgtgtggctgaactggtatcagcagaa gcccggcaaggcccccaagctgctgatctacaaggccagcaacctgcacaccggcgt gcccagcagattttctggcagcggctccggcaccgacttcaccctgacaatcagctccc tgcagcccgaggacattgccacctactactgccagcagggccagacctacccctacac ctttggccagggcaccaagctggaaatcaagcgtacggtggccgctcccagcgtgttc atcttcccacctagcgacgagcagctgaagtccggcacagcctctgtcgtgtgcctgct gaacaacttctaccccgcgaggcaaggtgcagtggaaggtggacaatgccctgca gagcggcaacagccaggaaagcgtgaccgagcaggacagcaaggactccacctac agcctgagcagcaccctgaccctgagcaaggccgactacgagaagcacaaggtgtac gcctgcgaagtgacccaccagggcctgtctagccccgtgaccaagagcttcaaccgg ggcgagtgt | SEQ ID NO: 379 |
| Heavy chain B | caggtgcagctggtggaatctggcggcggagtggtgcagcctggcagaagcctgaga ctgagctgtgccgccagcggcttcaccttcaccaaggcctggatgcactgggtgcgcc aggcccctggaaagcagctggaatgggtggcccagatcaaggacaagagcaacagc tacgccacctactacgccgacagcgtgaagggccggttcaccatcagccgggacgac agcaagaacaccctgtacctgcagatgaacagcctgcgggccgaggacaccgccgtg tactactgtcggggcgtgtactatgccctgagcccttcgattactggggccagggaac cctcgtgaccgtgtctagtgacaaaacccataccagagcccacctggtgcagtctggca ccgccatgaagaaaccaggcgcctctgtgcgggtgtcctgtcagacaagcggctacac cttcaccgcccacatcctgttctggttccggcaggcccctggcagaggactggaatggg tgggatggatcaagcccagtatggcgccgtgaacttcggcggaggcttccgggatag agtgaccctgacccgggacgtgtaccgcgagatcgcctacatggacatccgggggcct gaagcccgatgacaccgccgtgtactactgcgccagagacagaagctacggcgacag cagctgggctctggatgcttggggccagggcacaaccgtggtggtgtctgccgataag acccacaccgccagcacaaagggcccatcggtgcccctctggcccatgcagcagaa gcaccagcgaatctacagccgccctgggctgcctcgtgaaggactactttcccgagcc cgtgaccgtgtcctggaactctggcgctctgacaagcggcgtgcacaccttccagccg tgctccagagcagcggcctgtactctctgagcagcgtcgtgacagtgcccagcagcag cctgggcaccaagacctacacctgtaacgtggaccacaagcccagcaacaccaaggt ggacaagcgggtggaatctaagtacggcccctcctgccctccttgcccagcccctgaat tctctggcggaccctccgtgttcctgttccccccaaagcccaaggacaccctgatgatca gccggacccccgaagtgacctgcgtggtggtggatgtgtcccaggaagatcccgagg tgcagttcaattggtacgtggacggcgtggaagtgcacaacgccaagaccaagccag agaggaacagttcaacagcacctaccgggtggtgtccgtgctgaccgtgctgcaccag gactggctgaacggcaaagagtacaagtgcaaggtgtccaacaagggcctgcccagc tccatcgagaaaaccatcagcaaggccaagggccagccccgcgagcctcaagtgtgt acccctgcccctagccaggaagagatgaccaagaaccaggtgtccctgacctgtgcc gtgaaaggcttctaccccagcgacattgccgtggaatgggagagcaacggccagccc gagaacaactacaagaccaccccccctgtgctggacagcgacggctcattcttcctggt gtccaagctgaccgtggacaagagccggtggcaggaaggcaacgtgttcagctgctc cgtgatgcacgaggccctgcacaaccactacacccagaagtccctgtctctgtccctgg gcaag | SEQ ID NO: 380 |
| Light chain B | ttacatccacgtgacccagagccccagcagcctgtccgtgtccatcggcgacagagtga ccatcaactgccagacctctcagggcgtgggcagcgacctgcactggtatcagcacaa gcctggcagagcccccaagctgctgatccaccacacaagcagcgtggaagatggcgt gcccagcagattttccggcagcggcttccacaccagcttcaacctgaccatcagcgatc tgcaggccgacgacattgccacctactattgtcaggtgctgcagttcttcggcagaggca gcagactgcacatcaaggacaaaacccataccgacatcgtgatgacccagacccccct gagcctgagcgtgacacctggacagcctgccagcatcagctgcaagagcagccaga gcctggtgcacaacaacgccaacacctacctgagctggtatctgcagaagcccggcca gagccccagtcctgatctacaaggtgtccaacagattcagcggcgtgcccgacaga ttctccggcagcggctctggcaccgacttcaccctgaagatcagccgggtggaagccg aggacgtggcgtgtactattgtggccagggcacccagtaccccttcacctttggcagc ggcaccaaggtggaaatcaaggataagacccataccgtacggtggccgctcccagc gtgttcatcttcccacctagcgacgagcagctgaagtccggcacagcctctgtcgtgtgc ctgctgaacaacttctaccccgcgaggcaaagtgcagtggaaggtggacaacgcc ctgcagagcggcaacagccaggaaagcgtgaccgagcaggacagcaaggactcca cctacagcctgagcagcaccctgacactgagcaaggccgactacgagaagcacaag gtgtacgcctgcgaagtgacccaccagggcctgtctagccccgtgaccaagagcttca accggggcgagtgt | SEQ ID NO: 381 |

Binding Protein 42 Amino Acid Sequences

| | | |
|---|---|---|
| Heavy chain A | Qvqlqesgpgplvkpsqtlsltctvsgfslsdygvhwvrqppgkglewlgviwaggg tnynpslksrktiskdtsknqvslklssvtaadtavyycardkgysyyysmdywgq gttvtvssastkgpsvfplapcsrstsestaalgclvkdyfpepvtvswnsgaltsgvht fpavlqssglyslssvvtvpssslgtktytcnvdhkpsntkvdkrveskygppcppc papeflggpsvflfppkpkdtlmisrtpevtcvvvdvsqedpevqfnwyvdgvev hnaktkpreeqfnstyrvvsvltvlhqdwlngkeykckvsnkglpssiektiskakg qprepqvytippcqeemtknqvslwclvkgfypsdiavewesngqpennykttp pvldsdgsfflysklvdksrwqegnvfscsvmhealhnhytqkslslslgk | SEQ ID NO: 382 |

TABLE 2-continued

Heavy and light chain sequences of binding proteins. CDR sequences are bolded and italicized.

| | | |
|---|---|---|
| Light chain A | Divltqspaslavspgqratitcrasesveyyvtslmqwyqqkpgqppkllifaasn vesgvparfsgsgsgtdftltinpveandvanyycqqsrkvpytfggtkleikrtvaa psvfifppsdeqlksgtasvvcllnnfypreakvqwkvdnalqsgnsqesvteqdsk dstyslsstltlskadyekhkvyacevthqglsspvtksfnrgec | SEQ ID NO: 383 |
| Heavy chain B | Rahlvqsgtamkkpgasvrvscqtsgytftahilfwfrqapgrglewvgwi nkpqygavnfgggfrdrvtltrdvyreiaymdirglkpddtavyycardrsyg dsswaldawgqgttvvvsasqvqlvesgggvvqpgrslrlscaasgftftka wmhwvrqapgkqlewvaqikdksnsyatyyadsvkgrftisrddskntly lqmnslraedtavyycrgvyyalspfdywgqgtlvtvssrtastkgpsvfpla pcsrstsestaalgclvkdyfpepvtvswnsgaltsgvhtfpavlqssglyslss vvtvpssslgtktytcnvdhkpsntkvdkrveskygppcppcpapeflggps vflfppkpkdtlmisrtpevtcvvvdvsqedpevqfnwyvdgvevhnakt kpreeqfnstyrvvsvltvlhqdwlngkeykckvsnkglpssiektiskakg qprepqvctlppsqeemtknqvslscavkgfypsdiavewesngqpenny kttppvldsdgsfflvskltvdksrwqegnvfscsvmhealhnhytqkslsls lgk | SEQ ID NO: 384 |
| Light chain B | Divmtqtplslsvtpgqpasisckssqslvhnnantylswylqkpgqspqsliykvs nnrfsgvpdrfsgsgsgtdftlkisrveaedvgvyycqqgtqypftfgsgtkveikgpq kaapyihvtqspsslsvsigdrvtincqtsqgvgsdlhwyqhkpgrapkllihhtssv edgvpsrfsgsgfhtsfnltisdlqaddiatyycqvlqffgrgsrlhiktkgpsrtvaaps vfifppsdeqlksgtasvvcllnnfypreakvqwkvdnalqsgnsqesvteqdskds tyslsstltlskadyekhkvyacevthqglsspvtksfnrgec | SEQ ID NO: 385 |

Binding Protein 42 Nucleotide Sequences

| | | |
|---|---|---|
| Heavy chain A | caggtgcagctgcaggaatctggccctggcctcgtgaagcctagccagaccctgagc ctgacctgtaccgtgtccggcttcagcctgagcgactacggcgtgcactgggtgcgcc agccacctggaaaaggcctggaatggctgggcgtgatctgggctggcggaggcacc aactacaaccccagcctgaagtccagaaagaccatcagcaggcacaccagcaagaac caggtgtccctgaagctgagcagcgtgacagccgccgataccgccgtgtactactgcg ccagagacaagggctacagctactactacagcatggactactggggccagggcacca ccgtgaccgtgtcatccgcgtcgaccaagggcccctcggtgttcctctggcccttgc agcagaagcaccagcgaatctacagccgccctgggctgcctgtgaaggactactttc ccgagcccgtgaccgtgtcctggaactctggcgctctgacaagcggcgtgcacacctttt ccagccgtgctccagagcagcggcctgtactctctgagcagcgtcgtgacagtgccca gcagcagcctgggcaccaagacctacacctgtaacgtggaccacaagcccagcaaca ccaaggtggacaagcgggtggaatctaagtacggcccctcctgcctcccttgcccagc ccctgaatttctgggcggaccctccgtgttcctgttcccccccaaagcccaaggacaccct gatgatcagccggaccccccgaagtgacctgcgtggtggtggatgtgtcccaggaagat cccgaggtgcagttcaattggtacgtggacggcgtggaagtgcacaacgccaagacc aagcccagagaggaacagttcaacagcacctaccgggtggtgtccgtgctgaccgtg ctgcaccaggactggctgaacggcaaagagtacaagtgcaaggtgtccaacaagggc ctgcccagctccatcgagaaaaccatcagcaaggccaagggccagccccgcgagcc tcaagtgtataccctgccccctgccaggaagagatgaccaagaaccaggtgtccctgt ggtgtctcgtgaaaggcttctaccccagcgacattgccgtggaatgggagagcaacgg ccagcccgagaacaactacaagaccacccccccctgtgctggacagcgacggctcatt cttcctgtactccaagctgaccgtggacaagagccggtggcaggaaggcaacgtgttc agctgctccgtgatgcacgaggccctgcacaaccactacacccagaagtccctgtctct gtccctgggcaag | SEQ ID NO: 386 |
| Light chain A | gacatcgtgctgacacagagccctgctagcctggccgtgtctcctggacagagggcca ccatcacctgtagagccagcgagagcgtggaatattacgtgaccagcctgatgcagtg gtatcagcagaagcccggccagccccccaagctgctgattttcgccgccagcaacgtg gaaagcggcgtgccagccgattttcggcagcggctctggcaccgacttcacccctga ccatcaaccccgtggaagccaacgacgtggccaactactactgccagcagagccgga aggtgccctacacctttggccagggcaccaagctggaaatcaagcgtacggtggccg ctcccagcgtgttcatcttcccacctagcgacgagcagctgaagtccggcacagcctct gtcgtgtgcctgctgaacaacttctaccccgcgaggccaaggtgcagtggaaggtgg acaatgccctgcagagcggcaacagccaggaaagcgtgaccgagcaggacagcaa ggactccacctacagcctgagcagcaccctgaccctgagcaaggccgactacgagaa gcacaaggtgtacgcctgcgaagtgacccaccagggcctgtctagccccgtgaccaa gagcttcaaccggggcgagtgt | SEQ ID NO: 387 |
| Heavy chain B | agagcccacctggtgcagtctggcaccgccatgaagaaaccaggcgcctctgtgcgg gtgtcctgtcagacaagcggctacaccttcaccgcccacatcctgactggttccggcag gcccctggcagaggactggaatgggtgggatggatcaagcccagtatggcgcgtt aacttcggcggaggcttccgggatagagtgaccctgacccgggacgtgtaccgcgag atcgcctacatggacatccggggcctgaagcccgatgacaccgccgtgtactactgcg ccagagacaagagctacggcgacagcagctgggctctggatgcttggggccagggc acaaccgtggtggtgtctgcctctcaggtgcagctggtggaatctggcggaggagtgg tgcagcctggcagaagcctgagactgagctgtgccgccagcggcttcaccttcaccaa ggcctggatgcactgggtgcgccaggcccctggaaagcagctggaatgggtggccc agatcaaggacaagagcaacagctacgccacctactacgccgacagcgtgaagggc cggttcaccatcagccgggacgacagcaagaacaccctgtacctgcagatgaacagc ctgcgggccgaggacaccgccgtgtactactgtcggggcgtgtactatgccctgagcc | SEQ ID NO: 388 |

TABLE 2-continued

Heavy and light chain sequences of binding proteins. CDR sequences are bolded and italicized.

```
ccttcgattactggggccagggaaccctcgtgaccgtgtctagtcggaccgcttcgacc
aagggcccatcggtgttccctctggcccttgcagcagaagcaccagcgaatctacag
ccgccctgggctgcctcgtgaaggactactttcccgagcccgtgaccgtgtcctggaac
tctggcgctctgacaagcggcgtgcacacctttccagccgtgctccagagcagcggcc
tgtactctctgagcagcgtcgtgacagtgcccagcagcagcctgggcaccaagaccta
cacctgtaacgtggaccacaagcccagcaacaccaaggtggacaagcgggtggaat
ctaagtacggccctccctgcccctcttgcccagcccctgaatttctgggcggaccctcc
gtgttcctgttccccccaaagcccaaggacaccctgatgatcagccggacccccgaag
tgacctgcgtggtggtggatgtgtcccaggaagatcccgaggtgcagttcaattggtac
gtggacggcgtggaagtgcacaacgccaagaccaagcccagagaggaacagttcaa
cagcacctaccgggtggtgtccgtgctgaccgtgctgcaccaggactggctgaacgg
caaagagtacaagtgcaaggtgtccaacaagggcctgcccagctccatcgagaaaac
catcagcaaggccaaggccagccccgcgagcctcaagtgtgtaccctgcccctag
ccaggaagagatgaccaagaaccaggtgtccctgagctgtgccgtgaaaggcttctac
cccagcgacattgccgtggaatgggagagcaacggccagcccgagaacaactacaa
gaccacccccctgtgctggacagcgacggctcattcttcctggtgtccaagctgaccg
tggacaagagccggtggcaggaaggcaacgtgttcagctgctccgtgatgcacgagg
ccctgcacaaccactacacccagaagtccctgtctctgtccctgggcaag
```

| | | |
|---|---|---|
| Light chain B | gacatcgtgatgacccagacccccctgagcctgagcgtgacacctggacagcctgcc agcatcagctgcaagagcagccagagcctggtgcacaacaacgccaacacctacctg agctggtatctgcagaagcccggccagagcccccagtccctgatctacaaggtgtcca acagattcagcggcgtgcccgacagattctccggcagcggctctggcaccgacttcac cctgaagatcagccgggtggaagccgaggacgtgggcgtgtactattgtggccaggg cacccagtaccccttcaccttggcagcggcaccaaggtggaaatcaagggccagcc caaggccgcccctacatccacgtgacccagagccccagcagcctgtccgtgtccatc ggcgacagagtgaccatcaactgccagacctctcagggcgtgggcagcgacctgcac tggtatcagcacaagcctggcagagccccaagctgctgatcctaccacacaagcagc gtggaagatggcgtgcccagcagattttccggcagcggcttccacaccagcttcaacct gaccatcagcgatctgcaggccgacgacattgccacctactattgtcaggtgctgcagtt cttcggcagaggcagcagactgcacatcaagaccaagggccccagccgtacggtgg ccgctcccagcgtgttcatcttcccacctagcgacgagcagctgaagtccggcacagc ctctgtcgtgtgcctgctgaacaacttctaccccgcgaggccaaagtgcagtggaagg tggacaacgccctgcagagcggcaacagccaggaaagcgtgaccgagcaggacag caaggactccacctacagcctgagcagcaccctgacactgagcaaggccgactacga gaagcacaaggtgtacgctgcgaagtgacccaccagggcctgtctagccccgtgac caagagcttcaaccggggcgagtgt | SEQ ID NO: 389 |

Binding Protein 43 Amino Acid Sequences

| | | |
|---|---|---|
| Heavy chain A | Qvqlqesgpglvkpsqtlsltctvsgfslsdygvhwvrqppgkglewlgviwaggg tnynpslksrktiskdtsknqvslklssvtaadtavyycardkgysyyysmdywg qgttvtvssastkgpsvfplapcsrstsestaalgclvkdyfpepvtvswnsgaltsgv htfpavlqssglyslssvvtvpssslgtktytcnvdhkpsntkvdkrveskygppcpp cpapeflggpsvflfppkpkdtlmisrtpevtcvvvdvsqedpevqfnwyvdgve vhnaktkpreeqfnstyrvvsvltvlhqdwlngkeykckvsnkglpssiektiskak gqprepqvytippcqeemtknqvslwclvkgfypsdiavewesngqpennyktt ppvldsdgsfflyskltvdksrwqegnvfscsvmhealhnhytqkslslslgk | SEQ ID NO: 390 |
| Light chain A | Divltqspaslavspgqratitcrasesveyyvtslmwyqqkpgqppkllifaasn vesgvparfsgsgsgtdftltinpveandvanyycqqsrkvpytfgqgtkleikrtva apsvfifppsdeqlksgtasvvcllnnfypreakvqwkvdnalqsgnsqesvteqds kdstyslsstltlskadyekhkvyacevthqglsspvtksfnrgec | SEQ ID NO: 391 |
| Heavy chain B | Rahlvqsgtamkkpgasvrvscqtsgytftahilfwfrqapgrglewvgwi kpqygavnfgggfrdrvtltrdvyreiaymdirglkpddtavyycardrsyg dsswaldawgqgttvvvssasqvqlvesgggvvqpgrslrlscaasgft ftkawmhwvrqapgkqlewvaqikdksnsyatyyadsvkgrftisrddsk ntlylqmnslraedtavyycrgvyyalspfdywgqgtlvtvssrtastkg psvfplapcsrstsestaalgclvkdyfpepvtvswnsgaltsgvhtfpavlqs sglyslssvvtvpssslgtktytcnvdhkpsntkvdkrveskygppcppcpa peflggpsvflfppkpkdtlmisrtpevtcvvvdvsqedpevqfnwyvdgv evhnaktkpreeqfnstyrvvsvltvlhqdwlngkeykckvsnkglpssiek tiskakgqprepqvctlppsqeemtknqvslscavkgfypsdiavewesng qpennykttppvldsdgsfflvskltvdksrwqegnvfscsvmhealhnhy tqkslslslgk | SEQ ID NO: 392 |
| Light chain B | Divmtqtplslsvtpgqpasisckssqslvhnnantylswylqkpgqspqsliykvs nnrfsgvpdrfsgsgsgtdftlkisrveaedvgvyycgqgtqypftfgsgtkveikdkt htyihvtqspsslsvsigdrvtincqtsqgvgsdlhwyqhkpgrapkllihhtssved gvpsrfsgsgfhtsfnltisdlqaddiatyycqvlqffgrgsrlhiktkgpsrtvaapsvfi fppsdeqlksgtasvvcllnnfypreakvqwkvdnalqsgnsqesvteqdskdsty slsstltlskadyekhkvyacevthqglsspvtksfnrgec | SEQ ID NO: 393 |

TABLE 2-continued

Heavy and light chain sequences of binding proteins. CDR sequences are bolded and italicized.

Binding Protein 43 Nucleotide Sequences

| | | |
|---|---|---|
| Heavy chain A | caggtgcagctgcaggaatctggccctggcctcgtgaagcctagccagaccctgagc<br>ctgacctgtaccgtgtccggcttcagcctgagcgactacggcgtgcactgggtgcgcc<br>agccacctggaaaaggcctggaatggctgggcgtgatctgggctggcggaggcacc<br>aactacaaccccagcctgaagtccagaaagaccatcagcaaggacaccagcaagaac<br>caggtgtccctgaagctgagcagcgtgacagccgccgataccgccgtgtactactgcg<br>ccagagacaagggctacagctactactacagcatggactactggggccagggcacca<br>ccgtgaccgtgtcatccgcgtcgaccaagggcccctcggtgttccctctggccccttgc<br>agcagaagcaccagcgaatctacagccgccctgggctgcctcgtgaaggactactttc<br>ccgagcccgtgaccgtgtcctggaactctggcgctctgacaagcggcgtgcacacctt<br>ccagccgtgctccagagcagcggcctgtactctctgagcagcgtcgtgacagtgccca<br>gcagcagcctgggcaccaagacctacacctgtaacgtggaccacaagcccagcaaca<br>ccaaggtggacaagcgggtggaatctaagtacggccctccctgccctccttgcccagc<br>ccctgaatttctgggcggaccctccgtgttcctgttccccccaaagcccaaggacaccct<br>gatgatcagccggaccccgaagtgacctgcgtggtggtggatgtgtcccaggaagat<br>cccgaggtgcagttcaattggtacgtggacggcgtggaagtgcacaacgccaagacc<br>aagcccagagaggaacagttcaacagcacctaccgggtggtgtccgtgctgaccgtg<br>ctgcaccaggactggctgaacggcaaagagtacaagtgcaaggtgtccaacaagggc<br>ctgcccagctccatcgagaaaaccatcagcaaggccaagggccagccccgcgagcc<br>tcaagtgtatacccctgcccccttgccaggaagagatgaccaagaaccaggtgtccctgt<br>ggtgtctcgtgaaaggcttctaccccagcgacattgccgtggaatgggagagcaacgg<br>ccagcccgagaacaactacaagaccacccccctgtgctggacagcgacggctcatt<br>cttcctgtactccaagctgaccgtggacaagagccggtggcaggaaggcaacgtgttc<br>agctgctccgtgatgcacgaggccctgcacaaccactacacccagaagtccctgtctct<br>gtccctgggcaag | SEQ ID<br>NO: 394 |
| Light chain A | gacatcgtgctgacacagagccctgctagcctggccgtgtctcctggacagagggcca<br>ccatcacctgtagagccagcgagagcgtggaatattacgtgaccagcctgatgcagtg<br>gtatcagcagaagcccggccagccccccaagctgctgattttcgccgccagcaacgtg<br>gaaagcggcgtgccagccagattttccggcagcggctctggcacccgacttcacccta<br>ccatcaaccccgtggaagccaacgacgtggccaactactactgccagcagagccgga<br>aggtgccctacacctttggccagggcaccaagctggaaatcaagcgtacggtggccg<br>ctcccagcgtgttcatcttcccacctagcgacgagcagctgaagtccggcacagcctct<br>gtcgtgtgcctgctgaacaacttctatccccgcgaggccaaggtgcagtggaaggtgg<br>acaatgccctgcagagcggcaacagccaggaaagcgtgaccgagcaggacagcaa<br>ggactccacctacagcctgagcagcaccctgaccctgagcaaggccgactacgagaa<br>gcacaaggtgtacgcctgcgaagtgacccaccagggcctgtctagccccgtgaccaa<br>gagcttcaaccggggcgagtgt | SEQ ID<br>NO: 395 |
| Heavy chain B | agagcccacctggtgcagtctggcaccgccatgaagaaaccaggcgcctctgtgcgg<br>gtgtcctgtcagacaagcggctacaccttcaccgcccacatcctgttctggttccggcag<br>gcccctggcagaggactggaatgggtgggatggatcaagcccagtatggcgccgtg<br>aacttcggcggaggcttccgggatagagtgaccctgacccgggacgtgtaccgcgag<br>atcgcctacatggacatccggggcctgaagcccgatgacaccgccgtgtactactgcg<br>ccagagacagaagctacggcgacagcagctgggctctggatgcttggggccagggc<br>acaaccgtggtgtctgccgacaaaacccataccaggtgcagctggtggaatctg<br>gcggcggagtggtgcagcctggcagaagcctgagactgagctgtgccgccagcggc<br>ttcaccttcaccaaggcctggatgcactgggtgcgccaggcccctggaaagcagctgg<br>aatgggtggcccagatcaaggacaagagcaacagctacgccacctactacgccgaca<br>gcgtgaagggccggttcaccatcagccggacgacagcaagaacaccctgtacctgc<br>agatgaacagctgcgggccgaggacaccgccgtgtactactgcggggcgtgtact<br>atgccctgagccccttcgattactggggccagggaaccctcgtgaccgtgtctagtgat<br>aagacccacaccgcttcgaccaagggcccatcggtgttccctctggcccttgcagca<br>gaagcaccagcgaatctacagccgccctgggctgcctcgtgaaggactactttcccga<br>gcccgtgaccgtgtcctggaactctggcgctctgacaagcggcgtgcacacctttccag<br>ccgtgctccagagcagcggcctgtactctctgagcagcgtcgtgacagtgcccagcag<br>cagcctgggcaccaagacctacacctgtaacgtggaccacaagcccagcaacaccaa<br>ggtggacaagcgggtggaatctaagtacggccctccctgccctccttgcccagcccct<br>gaatttctgggcggaccctccgtgttcctgttccccccaaagcccaaggacacccctgat<br>gatcagccggaccccgaagtgacctgcgtggtggtggatgtgtcccaggaagatcc<br>cgaggtgcagttcaattggtacgtggacggcgtggaagtgcacaacgccaagaccaa<br>gcccagagaggaacagttcaacagcacctaccgggtggtgtccgtgctgaccgtgctg<br>caccaggactggctgaacggcaaagagtacaagtgcaaggtgtccaacaagggcctg<br>cccagctccatcgagaaaaccatcagcaaggccaagggccagccccgcgagcctca<br>agtgtataccctgcccctagccaggaagagatgaccaagaaccaggtgtccctgagc<br>tgtgccgtgaaaggcttctaccccagcgacattgccgtggaatgggagagcaacggcc<br>agcccgagaacaactacaagaccacccccctgtgctggacagcgacggctcattctt<br>cctggtgtccaagctgaccgtggacaagagccggtggcaggaaggcaacgtgttcag<br>ctgctccgtgatgcacgaggccctgcacaaccactacacccagaagtccctgtctctgt<br>ccctgggcaag | SEQ ID<br>NO: 396 |
| Light chain B | gacatcgtgatgacccagaccccctgagcctgagcgtgacacctggacagcctgcc<br>agcatcagctgcaagagcagccagagcctggtgcacaacaacgccaacacctacctg<br>agctggtatctgcagaagcccggccagagcccccagtccctgatctacaaggtgtcca<br>acagattcagcggcgtgcccgacagattctccggcagcggctctggcaccgacttcac<br>cctgaagatcagccgggtggaagccgaggacgtgggcgtgtactattgtggccaggg | SEQ ID<br>NO: 397 |

TABLE 2-continued

Heavy and light chain sequences of binding proteins. CDR sequences are bolded and italicized.

```
cacccagtaccccttcacctttggcagcggcaccaaggtggaaatcaaggacaaaacc
catacctacatccacgtgacccagagccccagcagcctgtccgtgtccatcggcgaca
gagtgaccatcaactgccagacctctcagggcgtgggcagcgacctgcactggtatca
gcacaagcctggcagagccccaagctgctgatccaccacaagcagcgtggaag
atggcgtgcccagcagattttccggcagcggcttccacaccagcttcaacctgaccatc
agcgatctgcaggccgacgacattgccacctactattgtcaggtgctgcagttcttcggc
agaggcagcagactgcacatcaaggataagacccataccgtacggtggccgctccc
agcgtgttcatcttcccacctagcgacgagcagctgaagtccggcacagcctctgtcgt
gtgcctgctgaacaacttctacccccgcgaggccaaagtgcagtggaaggtggacaa
cgccctgcagagcggcaacagccaggaaagcgtgaccgagcaggacaaggac
tccacctacagcctgagcagcaccctgacactgagcaaggccgactacgagaagcac
aaggtgtacgcctgcgaagtgacccaccagggcctgtctagccccgtgaccaagagc
ttcaaccggggcgagtgt
```

Binding Protein 44 Amino Acid Sequences

| | | |
|---|---|---|
| Heavy chain A | Qvqlqesgpglvkpsqtlsltctvsgfslsdygvhwvrqppgkglewlgviwaggg tnynpslksrktiskdtsknqvslklssvtaadtavyycardkgsyyyysmdywgq gttvtvssastkgpsvfplapcsrstsestaalgclvkdyfpepvtvswnsgaltsgvht fpavlqssglyslssvvtvpsssslgtktytcnvdhkpsntkvdkrveskygppcppc papeflggpsvflfppkpkdtlmisrtpevtcvvvdvsqedpevqfnwyvdgvev hnaktkpreeqfnstyrvvsvltvlhqdwlngkeykckvsnkglpssiektiskakg qprepqvytippcqeemtknqvslwclvkgfypsdiavewesngqpennykttp pvldsdgsffflysklvtdksrwqegnvfscsvmhealhnhytqkslslslgk | SEQ ID NO: 398 |
| Light chain A | Divltqspaslavspgqratitcrasesveyyvtslmqwyqqkpgqppkllifaasn vesgvparfsgsgsgtdftltinpveandvanyycqqsrkvpytfgqgtkleikrtvaa psvfifppsdeqlksgtasvvcllnnfypreakvqwkvdnalqsgnsqesvteqdsk dstyslsstltlskadyekhkvyacevthqglsspvtksfnrgec | SEQ ID NO: 399 |
| Heavy chain B | Qvqlvesgggyvqpgrslrlscaasgftftkawmhwyrqapgkqlewvaq inikdksnsyatyyadsvkgrftisrddskntlylqmnslraedtavyycrgvyy alspfdywgqgtlytysssrahlyqsgtamkkpgasvrvscqtsgytftahilf wfrqapgrglewygwikpqygavnfgggfrdrvtltrdvyreiaymdirgl kpddtavyycardrsygdsswaldawgqgttvvvsartastkgpsvfplapc srstsestaalgclykdyfpepytyswnsgaltsgyhtfpavlqssglyslssvv tvpssslgtktytcnvdhkpsntkvdkrveskygppcppcpapeflggpsvf lfppkpkdtlmisrtpevtcyvvvdvsqedpevqfnwyydgvevhnaktkp reeqfnstyrvvsvltvlhqdwlngkeykckvsnkglpssiektiskakgqpr epqvctlppsqeemtknqvslscavkgfypsdiavewesngqpennyktt ppvldsdgsffflvskltvdksrwqegnvfscsvmhealhnhytqkslslslgk | SEQ ID NO: 400 |
| Light chain B | Yihvtqspsslsvsigdrvtincqtsqgvgsdlhwyqhkpgrapkllihhtssvedg nvpsrfsgsgfhtsfnltisdlqaddiatyyqvlqffgrgsrlhikgqpkaapdivmtqt plslsvtpgqpasisckssqslvhnnantylswylqkpgqspqsliyvksnrfsgvpd rfsgsgsgtdftlkisrveaedvgvyycgqgtqypftfgsgtkveiktkgpsrtvaaps vfifppsdeqlksgtasvvcllnnfypreakvqwkvdnalqsgnsqesvteqdskds tyslsstltlskadyekhkvyacevthqglsspvtksfnrgec | SEQ ID NO: 401 |

Binding Protein 44 Nucleotide Sequences

| | | |
|---|---|---|
| Heavy chain A | caggtgcagctgcaggaatctggccctggcctcgtgaagcctagccagaccctgagc ctgacctgtaccgtgtccggcttcagcctgagcgactacggcgtgcactgggtgcgcc agccacctggaaaaggcctggaatggctgggcgtgatctggctggcggaggcacc aactacaaccccagcctgaagtccagaaagaccatcagcaaggacaccagcaagaac caggtgtccctgaagctgagcagcgtgacagccgccgataccgccgtgtactactgcg ccagagacaagggctacagctactactacagcatggactactggggccagggcacca ccgtgaccgtgtcatccgcgtcgaccaagggccctcggtgttccctctggcccttgc agcagaagcaccagcgaatctacagccgccctgggctgcctcgtgaaggactactttc ccgagcccgtgaccgtgtcctggaactctggcgctctgacaaggcggcgtgacaccttt ccagccgtgctccagagcagcggcctgtactctctgagcagcgtcgtgacagtgccca gcagcagcctgggcaccaagacctacacctgtaacgtggaccacaagcccagcaaca ccaaggtggacaagcgggtggaatctaagtacggccctcccgccctccttgcccagc ccctgaatttctgggcggaccctccgtgttcctgttccccccaaagcccaaggacaccct gatgatcagccggacccccgaagtgacctgcgtggtggtggatgtgtcccaggaagat cccgaggtgcagttcaattggtacgtggacggcgtggaagtgcacaacgccaagacc aagcccagagaggaacagttcaacagcacctaccgggtggtgtccgtgctgaccgtg ctgcaccaggactggctgaacggcaaagagtacaagtgcaaggtgtccaacaagggc ctgcccagctccatcgagaaaaccatcagcaaggccaagggccagccccgcgagcc tcaagtgtataccctgccccttgccaggaagagatgaccaagaaccaggtgtccctgt ggtgtctcgtgaaaggcttctaccccagcgacattgccgtggaatgggagaacaagg ccagcccgagaacaactacaagaccaccccccctgtgctggacagcgacggctcatt cttcctgtactccaagctgaccgtggacaagagccggtggcaggaaggcaacgtgttc agctgctccgtgatgcacgaggccctgcacaaccactacacccagaagtccctgtctct gtccctgggcaag | SEQ ID NO: 402 |

TABLE 2-continued

Heavy and light chain sequences of binding proteins. CDR sequences are bolded and italicized.

| | | |
|---|---|---|
| Light chain A | gacatcgtgctgacacagagccctgctagcctggccgtgtctcctggacagagggcca ccatcacctgtagagccagcgagagcgtggaatattacgtgaccgcctgatgcagtg gtatcagcagaagcccggccagccccccaagctgctgattttcgccgccagcaacgtg gaaagcggcgtgccagccagattttccggcagcggctctggcaccgacttcaccctga ccatcaaccccgtggaagccaacgacgtggccaactactactgccagcagagccgga aggtgccctacacctttggccagggcaccaagctggaaatcaagcgtacggtggccg ctcccagcgtgttcatcttcccacctagcgacgagcagctgaagtccggcacagcctct gtcgtgtgcctgctgaacaacttctaccccgcgaggccaaggtgcagtggaaggtgg acaatgccctgcagagcggcaacagccaggaaagcgtgaccgagcaggacagcaa ggactccacctacagcctgagcagcaccctgaccctgagcaaggccgactacgaaaa gcacaaggtgtacgcctgcgaagtgacccaccagggcctgtctagccccgtgaccaa gagcttcaaccggggcgagtgt | SEQ ID NO: 403 |
| Heavy chain B | caggtgcagctggtggaatctggcggcggagtggtgcagcctggcagaagcctgag actgagctgtgccgccagcggcttcaccttcaccaaggcctggatgcactgggtgcgc caggcccctggaaagcagctggaatgggtggcccagatcaaggacaagagcaacag ctacgccacctactacgccgacagcgtgaagggccggttcaccatcagccgggacga cagcaagaacaccctgtacctgcagatgaacagcctgcgggccgaggacaccgccg tgtactactgtcggggcgtgtactatgccctgagccccttcgattactggggccaggga accctcgtgaccgtgtctagtagcagagcccacctggtgcagtctggcaccgccatga agaaaccaggcgcctctgtgcgggtgtcctgtcagacaagcggctacaccttcaccgc ccacatcctgttctggttccggcaggcccctggcagaggactggaatgggtgggatgg atcaagccccagtatggccgcgtgaacttcggcgaggcttccgggatagagtgaccc tgacccgggacgtgtaccgcgagatcgcctacatggacatccggggcctgaagcccg atgacaccgccgtgtactactgcgccagagacagaagctacggcgacagcagctggg ctctggatgcttggggccagggcacaaccgtggtggtctgcccggaccgccagca caaagggcccatcggtgttccctctggcccttgcagcagaagcaccagcgaatctac agccgccctgggctgcctcgtgaaggactactttcccgagcccgtgaccgtgtcctgg aactctggcgctctgacaagcggcgtgcacacctttccagccgtgctccagagcagcg gcctgtactctctgagcagcgtcgtgacagtgcccagcagcagcctgggcacccaaga cctacacctgtaacgtggaccacaagcccagcaacaccaaggtggacaagcgggtg gaatctaagtacggcccctcctgccctccttgcccagcccctgaatttctgggcggacc ctccgtgttcctgttccccccaaagcccaaggacaccctgatgatcagccggacccc gaagtgacctgcgtggtggtggatgtgtcccaggaagatcccgaggtgcagttcaattg gtacgtggacggcgtggaagtgcacaacgccaagaccaagcccagagaggaacagt tcaacagcacctaccgggtggtgtccgtgctgaccgtgctgcaccaggactggctgaa cggcaaagagtacaagtgcaaggtgtccaacaagggcctgcccagctccatcgagaa aaccatcagcaaggccaagggccagccccgcgagcctcaagtgtgtaccctgccccc tagccaggaagagatgaccaagaaccaggtgtccctgagctgtgccgtgaaaggcttc taccccagcgacattgccgtggaatgggagagcaacggccagcccgagaacaacta caagaccacccccctgtgctggacagcgacggctcattcttcctggtgtccaagctga ccgtggacaagagccggtggcaggaaggcaacgtgttcagctgctccgtgatgcacg aggccctgcacaaccactacacccagaagtccctgtctctgtccctgggcaag | SEQ ID NO: 404 |
| Light chain B | tacatccacgtgacccagagccccagcagcctgtccgtgtccatcggcgacag agtgaccatcaactgccagacctctcagggcgtgggcagcgacctgcactggt atcagcacaagcctggcagagcccccaagctgctgatccaccacaagcag cgtggaagatggcgtgcccagcagattaccggcagcggcttccacaccagctt caacctgaccatcagcgatctgcaggccgacgacattgccacctactattgtca ggtgctgcagttcttcggcagaggcagcagactgcacatcaagggccagccc aaggccgcccccgacatcgtgatgacccagacccccctgagcctgagcgtga cacctggacagcctgccagcatcagctgcaagagcagccagagcctggtgca caacaacgccaacacctacctgagctggtatctgcagaagcccggccagagc ccccagtccctgatctacaaggtgtccaacagattcagcggcgtgcccgacag attctccggcagcggctctggcaccgacttcaccctgaagatcagccgggtgg aagccgaggacgtgggcgtgtactattgtggccagggcacccagtacccttc accttggcagcggcaccaaggtggaaatcaagaccaagggccccagccgta cggtggccgctcccagcgtgttcatcttcccacctagcgacgagcagctgaagt ccggcacagcctctgtcgtgtgcctgctgaacaacttctaccccgcgaggcca aagtgcagtggaaggtggacaacgccctgcagagcggcaacagccaggaaa gcgtgaccgagcaggacagcaaggactccacctacagcctgagcagcaccct gacactgagcaaggccgactacgagaagcacaaggtgtacgcctgcgaagtg acccaccagggcctgtctagccccgtgaccaagagcttcaaccggggcgagt gt | SEQ ID NO: 405 |

Binding Protein 45 Amino Acid Sequences

| | | |
|---|---|---|
| Heavy chain A | Qvqlqesgpglvkpsqtlsltctvsgfslsdygvhwvrqppgkglewlgviwagg ngtnynpslksrktiskdtsknqvslklssvtaadtavyycardkgysyyysmdywg qgttvtvssastkgpsvfplapcsrstsestaalgclvkdyfpepvtvswnsgaltsgv htfpavlqssglyslssvvtvpssslgtktytcnvdhkpsntkvdkrveskygppcpp cpapeflggpsvflfppkpkdtlmisrtpevtcvvvdvsqedpevqfnwyvdgve vhnaktkpreeqfnstyrvvsvltvlhqdwlngkeykckvsnkglpssiektiskak gqprepqvytippcqeemtknqvslwclvkgfypsdiavewesngqpennyktt ppvldsdgsfflysklltvdksrwqegnvfscsvmhealhnhytqkslslslgk | SEQ ID NO: 406 |

TABLE 2-continued

Heavy and light chain sequences of binding proteins. CDR sequences are bolded and italicized.

| | | |
|---|---|---|
| Light chain A | Divltqspaslavspgqratitcrasesveyyvtslmqwyqqkpgqppkllifaasn vesgvparfsgsgsgtdftltinpveandvanyycqqsrkvpytfggtkleikrtva apsvfifppsdeqlksgtasvvcllnnfypreakvqwkvdnalqsgnsqesvteqdsk kdstyslsstltlskadyekhkvyacevthqglsspvtksfnrgec | SEQ ID NO: 407 |
| Heavy chain B | yqvqlvesggggvqpgrslrlscaasgftftkawmhwyrqapgkqlewvaq ikdksnsyatyyadsvkgrftisrddskntlylqmnslraedtavyycrgvyy alspfdywgqgtlvtvsssrahlyqsgtamkkpgasvrvscqtsgytft ahilfwfrqapgrglewygwikpqygavnfgggfrdrvtltrdvyreiaym dirglkpddtavyycardrsygdsswaldawgqgttvvvsartastkgp svfplapcsrstsestaalgclykdyfpepytyswnsgaltsgyhtfpavlqss glyslssvvtvpssslgtktytcnvdhkpsntkvdkrveskygppcppcpap eflggpsvflfppkpkdtlmisrtpevtcyvvdvsqedpevqfnwyydgve vhnaktkpreeqfnstyrvvsvltvlhqdwlngkeykckvsnkglpssiekt iskakgqprepqvctlppsqeemtknqvslscavkgfypsdiavewesng qpennykttppvldsdgsffivskltvdksrwqegnvfscsvmhealhnhy tqkslslslgk | SEQ ID NO: 408 |
| Light chain B | Yihvtqspsslsvsigdrvtincqtsqgvgsdlhwyqhkpgrapkllihhtssvedg vpsrfsgsgfhtsfnltisdlqaddiatyycqvlqffgrgsrlhikgqpkaapdivmtqtpls lsvtpgqpasisckssqslvhnnantylswylqkpgqspqsliykvsnrfsgvpdrfs gsgsgtdftlkisrveaedvgvyycgqgtqypftfgsgtkveiktkgpsrtvaapsvfi fppsdeqlksgtasvvcllnnfypreakvqwkvdnalqsgnsqesvteqdskdsty slsstltlskadyekhkvyacevthqglsspvtksfnrgec | SEQ ID NO: 409 |

Binding Protein 45 Nucleotide Sequences

| | | |
|---|---|---|
| Heavy chain A | caggtgcagctgcaggaatctggccctggcctcgtgaagcctagccagaccctgagc ctgacctgtaccgtgtccggcttcagcctgagcgactacggcgtgcactgggtgcgcc agccacctggaaaaggcctggaatggctgggcgtgatctgggctggcggaggcacc aactacaaccccagcctgaagtccagaaagaccatcagcaaggacaccagcaagaac caggtgtccctgaagctgagcagcgtgacagccgccgataccgccgtgtactactgcg ccagagacaagggctacagctactactacagcatggactactggggccagggcacca ccgtgaccgtgtcatccgcgtcgaccaagggcccctcggtgttccctctggcccttgc agcagaagcaccagcgaatctacagccgcctgggctgcctcgtgaaggactactac ccgagcccgtgaccgtgtcctggaactctggcgctctgacaagcggcgtgcacacctt ccagccgtgctccagagcagcggcctgtactctctgagcagcgtcgtgacagtgccca gcagcagcctgggcaccaagacctacacctgtaacgtggaccacaagcccagcaaca ccaaggtggacaagcgggtggaatctaagtacggccctccctgccctcctgccagc ccctgaatactgggcggaccctccgtgacctgaccccccaaagcccaaggacaccct gatgatcagccggaccccgaagtgacctgcgtggtggtggatgtgtcccaggaagat cccgaggtgcagttcaattggtacgtggacggcgtggaagtgcacaacgccaagacc aagcccagagaggaacagttcaacagcacctaccgggtggtgtccgtgctgaccgtg ctgcaccaggactggctgaacggcaaagagtacaagtgcaaggtgtccaacaagggc ctgccagctccatcgagaaaaccatcagcaaggccaagggccagccccgcgagcc tcaagtgtataccctgccccagccaggaagagatgaccaagaaccaggtgtccctgt ggtgtctcgtgaaaggcttctaccccagcgacattgccgtggaatgggagagcaacgg ccagccgagaacaactacaagaccacccccctgtgctggacagcgacggctcatt cttcctgtactccaagctgaccgtggacaagagccggtggcaggaaggcaacgtgttc agctgctccgtgatgcacgaggccctgcacaaccactacacccagaagtccctgtctct gtccctgggcaag | SEQ ID NO: 410 |
| Light chain A | gacatcgtgctgacacagagccctgctagcctggccgtgtctcctggacagagggcca ccatcacctgtagagccagcgagagcgtggaatattacgtgaccagcctgatgcagtg gtatcagcagaagcccggccagccccccaagctgctgattttcgccgccagcaacgtg gaaagcggcgtgccagccgattttcggcagcggctctggcaccgacttcaccctga ccatcaaccccgtggaagccaacgacgtggccaactactactgccagcagagccgga aggtgccctacacctttggccagggcaccaagctggaaatcaagcgtacggtggccg ctcccagcgtgacatcacccacctagcgacgagcagctgaagtccggcacagcctct gtcgtgtgcctgctgaacaactctaccccgcgaggccaaggtgcagtggaaggtgg acaatgccctgcagagcggcaacagccaggaaagcgtgaccgagcaggacagcaa ggactccacctacagcctgagcagcaccctgacccctgagcaaggccgactacgagaa gcacaaggtgtacgcctgcgaagtgacccaccagggcctgtctagccccgtgaccaa gagcttcaaccggggcgagtgt | SEQ ID NO: 411 |
| Heavy chain B | caggtgcagctggtggaatctggcggcggagtggtgcagcctggcagaagcctgag actgagctgtgccgccagcggcttccacttcaccaaggcctggatgcactgggtgcgc caggcccctggaaagcagctggaatgggtggcccagatcaaggacaagaagagcaag ctacgccacctactacgccgacagcgtgaagggccggttcaccatcagccgggacga cagcaagaacacccctgtacctgcagatgaacagcctgcgggccgaggacaccgccg tgtactactgtcggggcgtgtactatgccctgagccccttcgattactggggccaggga accctcgtgaccgtgtctagtgacaaaaacccataccagagcccacctggtcagtctgg caccgccatgaagaaaccaggcgcctctgtgcgggtgtcctgtcagacaagcgcta caccacaccgcccacatcctgactggaccggcaggccctggcagaggactggaat gggtgggatggatcaagccccagtatggcgccgtgaacttcggcggaggcttccggg atagagtgaccctgacccgggacgtgtaccgcgagatcgcctacatggacatccggg gcctgaagcccgatgacaccgccgtgtactactgcgcgcgcagagacagaagctacggcg | SEQ ID NO: 412 |

TABLE 2-continued

Heavy and light chain sequences of binding proteins. CDR sequences are bolded and italicized.

| | | |
|---|---|---|
| | acagcagctgggctctggatgcttggggccagggcacaaccgtggtggtgtctgccg ataagacccacaccgccagcacaaagggcccatcggtgttccctctggcccttgcag cagaagcaccagcgaatctacagccgccctgggctgcctcgtgaaggactactaccc gagcccgtgaccgtgtcctggaactctggcgctctgacaagcggcgtgcacacctac agccgtgctccagagcagcggcctgtactctctgagcagcgtcgtgacagtgcccagc agcagcctgggcaccaagacctacacctgtaacgtggaccacaagcccagcaacacc aaggtggacaagcgggtggaatctaagtacggccctccctgcccctccttgcccagccc ctgaatttctggcggaccctccgtgttcctgttcccccaaagcccaaggacaccctg atgatcagccggacccccgaagtgacctgcgtggtggtggatgtgtcccaggaagatc ccgaggtgcagttcaattggtacgtggacggcgtggaagtgcacaacgccaagacca gcccagagaggaacagttcaacagcacctaccgggtggtgtccgtgctgaccgtgct gcaccaggactggctgaacggcaaagagtacaagtgcaaggtgtccaacaagggcct gcccagctccatcgagaaaaccatcagcaaggccaagggccagccccgcgagcctc aagtgtgtaccctgccccctagccaggaagagatgaccaagaaccaggtgtccctgag ctgtgccgtgaaaggcttctaccccagcgacattgccgtggaatgggagagcaacggc cagcccgagaacaactacaagaccacccccctgtgctggacagcgacggctcattct tcctggtgtccaagctgaccgtggacaagagccgtggcaggaaggcaacgtgttca gctgctccgtgatgcacgaggccctgcacaaccactacacccagaagtccctgtctctg tccctgggcaag | |
| Light chain B | tacatccacgtgacccagagccccagcagcctgtccgtgtccatcggcgacagagtga catcaactgccagacctctcagggcgtgggcagcgacctgcactggtatcagcacaa gcctggcagagcccccaagctgctgatccaccacacaagcagcgtggaagatggcgt gcccagcagattaccggcagcggcttccacaccagcttcaacctgaccatcagcgatc tgcaggccgacgacattgccacctactattgtcaggtgctgcagttcttcggcagaggc agcagactgcacatcaaggacaaaacccataccgacatcgtgtgaccccagaccccc ctgagcctgagcgtgacacctggacagcctgccagcatcagctgcaagagcagccag agcctggtgcacaacaacgccaacacctacctgagctggtatctgcagaagcccggc cagagcccccagtccctgatctacaaggtgtccaacagattcagcggcgtgcccgaca gattctccggcagcggctctggcaccgacttcaccctgaagatcagccgggtggaagc cgaggacgtgggcgtgtactattgtggccagggcacccagtacccccttcacctaggca gcggcaccaaggtggaaatcaaggataagacccatacccgtacggtggccgctcca gcgtgacatcttcccacctagcgacgagcagctgaagtccggcacagcctctgtcgtg tgcctgctgaacaacttctaccccgcgaggccaaagtgcagtggaaggtggacaac gccctgcagagcggcaacagccaggaaagcgtgaccgagcaggacagcaaggact ccacctacagcctgagcagcaccctgacactgagcaaggccgactacgagaagcaca aggtgtacgcctgcgaagtgacccaccagggcctgtctagccccgtgaccaagagctt caaccggggcgagtgt | SEQ ID NO: 413 |

Binding Protein 46 Amino Acid Sequences

| | | |
|---|---|---|
| Heavy chain A | Qvqlvqsgaevvkpgasvkvsckasgytftsyyihwvrqapgqglewigsiypg nvntnyaqkfqgratltvdtsistaymelsrlrsddtavyyctrshygldwnfdvwgk gttvtvssastkgpsvfplapcsrstsestaalgclvkdyfpepvtvswnsgaltsgvht fpavlqssglyslssvvtvpssslgtktytcnvdhkpsntkvdkrveskygppcppc papeflggpsvflfppkpkdtlmisrtpevtcvvvdvsqedpevqfnwyvdgvev hnaktkpreeqfnstyrvvsvltvlhqdwlngkeykckvsnkglpssiektiskakg qprepqvytlppcqeemtknqvslwclvkgfypsdiavewesngqpennykttp pvldsdgsfflyskltvdksrwqegnvfscsvmhealhnhytqkslslslgk | SEQ ID NO: 414 |
| Light chain A | Diqmtqspsslsasvgdrvtltcqasqniyvvwlnwyqqkpgkapklliykasnlht gvpsrfsgsgsgtdftltisslqpediatyycqqgqtypytfgqgtkleikrtvaapsvfi fppsdeqlksgtasvvcllnnfypreakvqwkvdnalqsgnsqesvteqdskdsty slsstltlskadyekhkvyacevthqglsspvtksfnrgec | SEQ ID NO: 415 |
| Heavy chain B | Qvhltqsgpevrkpgtsvkvsckapgntlktydlhwvrsvpgqglqwmg wishegdkkviverfkakvtidwdrstntaylqlsgltsgdtavyycakgskh rlrdyalydddgalnwavdvdylsnlefwgqgtavtvsssqvqlvesgggv vqpgrslrlscaasgftftkawmhwvrqapgkqlewvaqikdksnsyatyy adsvkgrftisrddskntlylqmnslraedtavyycrgvyyalspfdywgqg tlvtvssrtastkgpsvfplapcsrstsestaalgclvkdyfpepvtvswnsgalt sgvhtfpavlqssglyslssvvtvpssslgtktytcnvdhkpsntkvdkrvesk ygppcppcpapeflggpsvflfppkpkdtlmisrtpevtcvvvdvsqedpe vqfnwyvdgvevhnaktkpreeqfnstyrvvsvltvlhqdwlngkeykck vsnkglpssiektiskakgqprepqvctlppsqeemtknqvslscavkgfyp sdiavewesngqpennykttppvldsdgsfflvskltvdksrwqegnvfscs vmhealhnhytqkslslslgk | SEQ ID NO: 416 |
| Light chain B | Divmtqtplslsvtpgqpasisckssqslvhnnantylswylqkpgqspqsliykvs nrfsgvpdrfsgsgsgtdftlkisrveaedvgvyycgqgtqypftfgsgtkveikgqp kaapdfvltqsphslsvtpgesasiscksshslihgdrnnylawyvqkpgrspqlliyl assrasgvpdrfsgsgsdkdftlkisretedvgtyycmqgrespwtfgqgtkvdikt kgpsrtvaapsvfifppsdeqlksgtasvvcllnnfypreakvqwkvdnalqsgnsq evteqdskdstyslsstltlskadyekhkvyacevthqglsspvtksfnrgec | SEQ ID NO: 417 |

TABLE 2-continued

Heavy and light chain sequences of binding proteins. CDR sequences are bolded and italicized.

Binding Protein 46 Nucleotide Sequences

| | | |
|---|---|---|
| Heavy chain A | caggtgcagctggtgcagtctggcgccgaggtcgtgaaacctggcgcctctgtgaag tgtcctgcaaggccagcggctacacctttaccagctactacatccactgggtgcgcca ggcccctggacagggactggaatggatcggcagcatctaccccggcaacgtgaacac caactacgcccagaagttccagggcagagccaccctgaccgtggacaccagcatcag caccgcctacatggaactgagccggctgagaagcgacgacaccgccgtgtactactg cacccggtcccactacggcctggattggaacttcgacgtgtgggcaagggcaccac cgtgacagtgtctagcgcgtcgaccaagggcccctcggtgaccctctggccccttgca gcagaagcaccagcgaatctacagccgccctgggctgcctcgtgaaggactactttcc cgagcccgtgaccgtgtcctggaactctggcgctctgacaagcggcgtgcacacctac cagccgtgctccagagcagcggcctgtactctctgagcagcgtcgtgacagtgcccag cagcagcctgggcaccaagacctacacctgtaacgtggaccacaagcccagcaacac caaggtggacaagcgggtggaatctaagtacggccctccctgccctccttgcccagcc cctgaatactgggcggaccctccgtgacctgttcccccaaagcccaaggacaccct gatgatcagccggacccccgaagtgacctgcgtggtggtggatgtgtcccaggaagat cccgaggtgcagttcaattggtacgtggacggcgtggaagtgcacaacgccaagacc aagcccagagaggaacagttcaacagcacctaccgggtggtgtccgtgctgaccgtg ctgcaccaggactggctgaacggcaaagagtacaagtgcaaggtgtccaacaagggc ctgcccagctccatcgagaaaaccatcagcaaggccaagggccagccccgcgagcc tcaagtgtacccctgccccttgccaggaagagatgaccaagaaccaggtgtccctgt ggtgtctcgtgaaaggcttctaccccagcgacattgccgtggaatgggagagcaacgg ccagcccgagaacaactacaagaccaccccccctgtgctggacagcgacggctcatt cttcctgtactccaagctgaccgtggacaagagccggtggcaggaaggcaacgtgttc agctgctccgtgatgcacgaggccctgcacaaccactacacccagaagtccctgtctct gtccctgggcaag | SEQ ID NO: 418 |
| Light chain A | gacatccagatgacccagagcccagcagcctgtctgccagcgtgggcgacagagtg accatcacctgtcaggccagcagaacatctacgtgtggctgaactggtatcagcagaa gcccggcaaggcccccaagctgctgatctacaaggccagcaacctgcacaccggcgt gcccagcagattactggcagcggctccggcaccgacttccctgacaatcagctccc tgcagcccgaggacattgccacctactactgccagcagggccagacctaccctacac ctttggccagggcaccaagctggaaatcaagcgtacggtggccgctcccagcgtgttc atcttcccacctagcgacgagcagctgaagtccggcacagcctctgtcgtgtgcctgct gaacaacttctaccccgcgaggccaaggtgcagtggaaggtggacaatgccctgca gagcggcaacagccaggaaagcgtgaccgagcaggacagcaaggactccacctac agcctgagcagcaccctgaccctgagcaaggccgactacgagaagcacaaggtgta cgcctgcgaagtgacccaccagggcctgtctagccccgtgaccaagagcttcaaccg gggcgagtgt | SEQ ID NO: 419 |
| Heavy chain B | caggtgcacctgacacagagcggacccgaagtgcggaagcctggcacctctgtgaa ggtgtcctgcaaggccctggcaacaccctgaaaacctacgacctgcactgggtgcgc agcgtgccaggacagggactgcagtggatgggctggatcagccacgagggcgacaa gaaagtgatcgtggaacggttcaaggccaaagtgaccatcgactgggacagaagcac caacaccgcctacctgcagctgagcggcctgacctctggcgataccgccgtgtactact gcgccaagggcagcaagcaccggctgagagactacgccctgtacgacgatgacggc gccctgaactgggcccgtgggatgtggactacctgagcaacctggaattctgggcgcagg gcacagccgtgaccgtgtcatcttctcaggtgcagctggtggaatctggcggcggagt ggtgcagcctggcagaagcctgagactgagctgtgccgcagcggcttcaccttcacc aaggcctggatgcactgggtgcgccaggcccctggaaagcagctggaatgggtggc ccagatcaaggacaagagcaacagctacgccacctactacgccgacagcgtgaagg gccggttcaccatcagccgggacgacagcaagaacacccgtacctgcagatgaaca gcctgcgggccgaggacaccgccgtgtactactgtcggggcgtgtactatgccctgag ccccttcgattactggggccagggaaccctcgtgaccgtgtctagtcggaccgcttcgc ccaagggcccatcggtgaccctctggccccttgcagcagaagcaccagcgaatctac agccgcctgggctgcctcgtgaaggactactacccgagcccgtgaccgtgtcctgg aactctggcgctctgacaagcggcgtgcacaccttccagccgtgctccagagcagcg gcctgtactctctgagcagcgtcgtgacagtgcccagcagcagcctgggcaccaaga cctacacctgtaacgtggaccacaagcccagcaacaccaaggtggacaagcgggtg gaatctaagtacggccctccctgccctccttgcccagcccctgaatttctgggcggacc ctccgtgttcctgttcccccaaagcccaaggacaccctgatgatcagccggacccc gaagtgacctgcgtggtggtggatgtgtcccaggaagatcccgaggtgcagttcaattg gtacgtggacggcgtggaagtgcacaacgccaagaccaagcccagagaggaacagt tcaacagcacctaccgggtggtgtccgtgctgaccgtgctgcaccaggactggctgaa cggcaaagagtacaagtgcaaggtgtccaacaagggcctgcccagctccatcgagaa aaccatcagcaaggccaagggccagccccgcgagcctcaagtgtataccctgccccc tagccaggaagagatgaccaagaaccaggtgtccctgagctgtgccgtgaaaggcttc taccccagcgacattgccgtggaatgggagagcaacggccagcccgagaacaacta caagaccaccccccctgtgctggacagcgacggctcattcttcctggtgtccaagctga ccgtggacaagagccggtggcaggaaggcaacgtgttcagctgctccgtgatgcacg aggccctgcacaaccactacacccagaagtccctgtctctgtccctgggcaag | SEQ ID NO: 420 |
| Light chain B | gacatcgtgatgacccagaccccctgagcctgagcgtgacacctggacagcctgcc agcatcagctgcaagagcagccagagcctggtgcacaacaacgccaacacctacctg agctggtatctgcagaagcccggccagagccccagtccctgatctacaaggtgtcca acagattcagcggcgtgcccgacagattctccggcagcggctctggcaccgacttcac cctgaagatcagccgggtggaagccgaggacgtgggcgtgtactattgtggccaggg | SEQ ID NO: 421 |

TABLE 2-continued

Heavy and light chain sequences of binding proteins. CDR sequences are bolded and italicized.

```
cacccagtaccccttcacctttggcagcggcaccaaggtggaaatcaagggccagcc
caaggccgcccccgacttcgtgctgacccagagccctcacagcctgagcgtgacacc
tggcgagagcgccagcatcagctgcaagagcagccactccctgatccacggcgacc
ggaacaactacctggcttggtacgtgcagaagcccggcagatcccccagctgctgat
ctacctggccagcagcagagccagcggcgtgcccgatagattactggcagcggcag
cgacaaggacttcaccctgaagatcagccgggtggaaaccgaggacgtgggcccta
ctactgtatgcagggcagagagagcccctggacctaggccagggcaccaaggtgga
catcaagaccaagggccccagccgtacggtggccgctcccagcgtgttcatcttccca
cctagcgacgagcagctgaagtccggcacagcctctgtcgtgtgcctgctgaacaactt
ctaccccgcgaggccaaagtgcagtggaaggtggacaacgccctgcagagcggca
acagccaggaaagcgtgaccgagcaggacagcaaggactccacctacagcctgagc
agcaccctgacactgagcaaggccgactacgagaagcacaaggtgtacgcctgcga
agtgacccaccagggcctgtctagccccgtgaccaagagcttcaaccggggcgagtg
t
```

Binding Protein 47 Amino Acid Sequences

| | | |
|---|---|---|
| Heavy chain A | Qvqlvqsgaevvkpgasvkvsckasgytftsyyihwvrqapgqglewigsiypgn nvntnyaqkfqgratltvdtsistaymelsrlrsddtavyyctrshygldwnfdvwgkg ttvtvssastkgpsvfplapcsrstsestaalgclvkdyfpepvtvswnsgaltsgvhtf pavlqssglyslssvvtvpssslgtktytcnvdhkpsntkvdkrveskygppcppcp apeflggpsvflfppkpkdtlmisrtpevtcvvvdvsqedpevqfnwyvdgvevh naktkpreeqfnstyrvvsvltvlhqdwlngkeykckvsnkglpssiektiskakgq prepqvytlppcqeemtknqvslwclvkgfypsdiavewesngqpennykttpp vldsdgsfflyskltvdksrwqegnvfscsvmhealhnhytqkslslslgk | SEQ ID NO: 422 |
| Light chain A | Diqmtqspsslsasvgdrvtltcqasqniyvvwlnwyqqkpgkapklliykasnlht gvpsrfsgsgsgtdftltisslqpediatyycqqgqtypytfgqgtkleikrtvaapsvfi fppsdeqlksgtasvvcllnnfypreakvqwkvdnalqsgnsqesvteqdskdsty slsstltlskadyekhkvyacevthqglsspvtksfnrgec | SEQ ID NO: 423 |
| Heavy chain B | Qvhltqsgpevrkpgtsvkvsckapgntlktydlhwvrsvpgqglqwmg wishegdkkviverfkakvtidwdrstntaylqlsgltsgdtavyycakgskh rlrdyalydddgalnwavdvdylsnlefwgqgtavtvsssqvqlvesgg gvvqpgrslrlscaasgftftkawmhwvrqapgkqlewvaqikdksnsy atyyadsvkgrftisrddskntlylqmnslraedtavyycrgvyyalspfdyw gqgtlvtvssrtastkgpsvfplapcsrstsestaalgclvkdyfpepvtvs wnsgaltsgvhtfpavlqssglyslssvvtvpssslgtktytcnvdhkpsntkv dkrveskygppcppcpapeflggpsvflfppkpkdtlmisrtpevtcvvvd vsqedpevqfnwyvdgvevhnaktkpreeqfnstyrvvsvltvlhqdwln gkeykckvsnkglpssiektiskakgqprepqvctlppsqeemtknqvslsc avkgfypsdiavewesngqpennykttppvldsdgsfflvskltvdksrwq egnvfscsvmhealhnhytqkslslslgk | SEQ ID NO: 424 |
| Light chain B | Divmtqtplslsvtpgqpasisckssqslvhnnantylswylqkpgqspqsliykvs nnrfsgvpdrfsgsgsgtdftlkisrveaedvgvyycgqgtqypftfgsgtkveikfkth tdfvltqsphslsvtpgesasisckssrslihgdrnnylawyvqkgrspqlliylassr asgvpdrfsgsgsdkdftlkisrvetedvgtycmqgrespwtfgqgtkvdikdkth trtvaapsvfifppsdeqlksgtasvvcllnnfypreakvqwkvdnalqsgnsqesvt eqdskdstyslsstltlskadyekhkvyacevthqglsspvtksfnrgec | SEQ ID NO: 425 |

Binding Protein 47 Nucleotide Sequences

| | | |
|---|---|---|
| Heavy chain A | caggtgcagctggtgcagtctggcgccgaggtcgtgaaacctggcgcctctgtgaagg tgtcctgcaaggccagcggctacacctttaccagctactacatccactgggtgcgccag gcccctggacagggactggaatggatcggcagcatctaccccggcaacgtgaacacc aactacgcccagaagaccagggcagagccaccctgaccgtggacaccagcatcagc accgcctacatggaactgagccggctgagaagcgacgacaccgccgtgtactactgc acccggtcccactacggcctggattggaacttcgacgtgggggcaagggcaccacc gtgacagtgtctagcgcgtcgaccaagggccctcggtgttccctctggcccctgcag cagaagcaccagcgaatctacagccgccctgggctgcctcgtgaaggactactttccc gagcccgtgaccgtgtcctggaactctggcgctctgacaagcggcgtgcacacctacc agccgtgctccagagcagcggcctgtactctctgagcagcgtcgtgacagtgcccagc agcagcctgggcaccaagacctacacctgtaacgtggaccacaagcccagcaacacc aaggtggacaagcgggtggaatctaagtacgccctccctgccctccttgcccagccc ctgaatactggccggaccctccgtgttcctgttcccccaaagcccaaggacaccctga tgatcagccggaccccagaagtgacctgcgtggtggtggatgtgtcccaggaagatcc cgaggtgcagttcaattggtacgtggacggcgtggaagtgcacaacgccaagaccaa gccccagagaggaacagttcaacagcacctaccgggtggtgtccgtgctgaccgtgctg caccaggactggctgaacggcaaagagtacaagtgcaaggtgtccaacaagggcctg cccagctccatcgagaaaaccatcagcaaggccaagggccagccccgcgagcctca agtgtataccctgccccctccccaggaagagatgaccaagaaccaggtgtccctgtgg gtctcgtgaaaggcttctaccccagcgacattgccgtggaatgggagagcaacgcca gcccgagaacaactacaagaccacccccctgtgctggacagcgacggctcattcttc ctgtactccaagctgaccgtggacaagagccggtggcaggaaggcaacgtgacagct gctccgtgatgcacgaggccctgcacaaccactacacccagaagtccctgtctctgtcc ctgggcaag | SEQ ID NO: 426 |

TABLE 2-continued

Heavy and light chain sequences of binding proteins. CDR sequences are bolded and italicized.

| | | |
|---|---|---|
| Light chain A | gacatccagatgacccagagccccagcagcctgtctgccagcgtgggcgacagagtg accatcacctgtcaggccagccagaacatctacgtgtggctgaactggtatcagcagaa gcccggcaaggcccccaagctgctgatctacaaggccagcaacctgcacaccggcgt gcccagcagattactggcagcggctccggcaccgacttcaccctgacaatcagctccc tgcagcccgaggacattgccacctactactgccagcagggccagacctaccctacac ctttggccagggcaccaagctggaaatcaagcgtacggtggccgctcccagcgtgac atcttcccacctagcgacgagcagctgaagtccggcacagcctctgtcgtgtgcctgct gaacaacttctaccccgcgaggcaaggtgcagtggaaggtggacaatgccctgca gagcggcaacagccaggaaagcgtgaccgagcaggacagcaaggactccacctac agcctgagcagcaccctgaccctgagcaaggccgactacgagaagcacaaggtgtac gcctgcgaagtgacccaccagggcctgtctagccccgtgaccaagagcttcaaccgg ggcgagtgt | SEQ ID NO: 427 |
| Heavy chain B | caggtgcacctgacacagagcggacccgaagtgcggaagcctggcacctctgtgaag gtgtcctgcaaggcccctggcaacaccctgaaaacctacgacctgcactgggtgcgca gcgtgccaggacagggactgcagtggatgggctggatcagccacgagggcgacaag aaagtgatcgtggaacggttcaaggccaaagtgaccatccagctggacagaagcacc aacaccgcctacctgcagctgagcggcctgacctctggcgataccgccgtgtactactg cgccaagggcagcaagcaccggctgagagactacgccctgtacgacgatgacggcg ccctgaactgggccgtggatgtggactacctgagcaacctggaattctggggccaggg cacagccgtgaccgtgtcatctgacaaaacccatacccaggtgcagctggtggaatctg gcggcggagtggtgcagcctggcagaagcctgagactgagctgtgccgccagcggc ttcaccttcaccaaggcctggatgcactgggtgcgccaggcccctggaaagcagctgg aatgggtggcccagatcaaggacaagagcaacagctacgccacctactacgccgaca gcgtgaagggccggttcaccatcagccgggacgacagcaagaacaccctgtacctgc agatgaacagcctgcgggccgaggacaccgccgtgtactactgtcggggcgtgtacta tgccctgagcccctttcgattactggggccagggaaccctcgtgaccgtgtctagtgataa gacccacaccgcttcgaccaagggcccatcggtgaccctctggcccccttgcagcaga agcaccagcgaatctacagcgccctgggctgcctcgtgaaggactactacccgagc ccgtgaccgtgtcctgaactctggcgctctgacaagcggcgtgcacacctttccagcc gtgctccagagcagcggcctgtactctctgagcagcgtcgtgacagtgcccagcagca gcctgggcaccaagacctacacctgtaacgtggaccacaagcccagcaacaccaagg tggacaagcgggtggaatctaagtacggcccctccctgccctccttgcccagcccctgaa tttctgggcggaccctccgtgacctgacccccaaagcccaaggacaccctgatgatc agccggaccccgaagtgacctgcgtggtggtggatgtgtcccaggaagatccccgag gtgcagttcaattggtacgtggacggcgtggaagtgcacaacgccaagaccaagccca gagaggaacagttcaacagcacctaccgggtggtgtccgtgctgaccgtgctgcacca ggactggctgaacggcaaagagtacaagtgcaaggtgtccaacaagggcctgccccag ctccatcgagaaaaccatcagcaaggccaagggccagccccgcgagcctcaagtgtg taccctgcccctagccaggaagagatgaccaagaaccaggtgtccctgagctgtgcc gtgaaaggcttctaccccagcgacattgccgtggaatgggagagcaacggccagccc gagaacaactacaagaccacccccctgtgctggacagcgacggctcattcttcctggt gtccaagctgaccgtggacaagagccggtggcaggaaggcaacgtgacagctgctc cgtgatgcacgaggccctgcacaaccactacacccagaagtccctgtctctgtccctgg gcaag | SEQ ID NO: 428 |
| Light chain B | gacatcgtgatgacccagacccccctgagcctgagcgtgacacctggacagcctgcca gcatcagctgcaagagcagccagagcctggtgcacaacaacgccaacacctacctga gctggtatctgcagaagcccggccagagccccagtccctgatctacaaggtgtccaa cagattcagcggcgtgcccgacagattctccggcagcggctctggcaccgacttcacc ctgaagatcagcgggtgaagccgaggacgtgggcgtgtactattgtcagcagggc acccagtacccttcacctaggcagcggcaccaaggtggaaatcaaggacaaaaccc ataccgacttcgtgctgacccagagccctcacagcctgagcgtgacacctggcgagag cgccagcatcagctgcaagagcagccactccctgatccacgcgaccggaacaacta cctggcttggtacgtgcagaagcccggcagtcccccagctgctgatctacctggcca gcagagagccagcggcgtgcccgatagattactggcagcggcagcgacaaggact tcaccctgaagatcagccgggtggaaaccgaggacgtgggcacctactactgtatgca gggcagagagagcccctggacctaggccagggcaccaaggtggacatcaaggataa gacccatacccgtacggtggccgctcccagcgtgttcatcttcccaccctagcgacgagc agctgaagtccggcacagcctctgtcgtgtgcctgctgaacaacttctaccccgcgag gccaaagtgcagtggaaggtggacaacgccctgcagagcggcaacagccaggaaa gcgtgaccgagcaggacagcaaggactccacctacagcctgagcagcaccctgaca ctgagcaaggccgactacgagaagcacaaggtgtacgcctgcgaagtgacccaccag ggcctgtctagccccgtgaccaagagcttcaaccggggcgagtgt | SEQ ID NO: 429 |

Binding Protein 48 Amino Acid Sequences

| | | |
|---|---|---|
| Heavy chain A | Qvqlvqsgaevvkpgasvkvsckasgytftsyyihwvrqapgqglewigsiypgn invntnyaqkfqgratltvdtsistaymelsrlrsddtavyyctrshygldwnfdvwgkg ttvtvssastkgpsvfplapcsrstsestaalgclvkdyfpepvtvswnsgaltsgvhtf pavlqssglyslssvvtvpssslgtktytcnvdhkpsntkvdkrveskygppcpppcp apeflggpsvflfppkpkdtlmisrtpevtcvvvdvsqedpevqfnwyvdgvevh naktkpreeqfnstyrvvsvltvlhqdwlngkeykckvsnkglpssiektiskakgq prepqvytlppcqeemtknqvslwclvkgfypsdiavewesngqpennykttpp vldsdgsfflysklltvdksrwqegnvfscsvmhealhnhytqkslslslgk | SEQ ID NO: 430 |

TABLE 2-continued

Heavy and light chain sequences of binding proteins. CDR sequences are bolded and italicized.

| | | |
|---|---|---|
| Light chain A | Diqmtqspsslsasvgdrvtltcqasqniyvwlnwyqqkpgkapklliykasnlht ngvpsrfsgsgsgtdftltisslqpediatyycqqgqtypytfgqgtkleikrtvaapsvfi fppsdeqlksgtasvvcllnnfypreakvqwkvdnalqsgnsqesvteqdskdstys lsstltlskadyekhkvyacevthqglsspvtksfnrgec | SEQ ID NO: 431 |
| Heavy chain B | Qvqlvesgggvvqpgrslrlscaasgftftkawmhwvrqapgkqlewvaq ikdksnsyatyyadsvkgrftisrddskntlylqmnslraedtavyycrgvyy alspfdywgqgtlvtvsssqvhltqsgpevrkpgtsvkvsckapgntlktydl hwvrsvpgqglqwmgwishegdkkviverfkakvtidwdrstntaylqls gltsgdtavyycakgskhrlrdyalydddgalnwavdvdyslnlefwgqgt avtvssrtastkgpsvfplapcsrstsestaalgclvkdyfpepvtvswnsgalt sgvhtfpavlqssglyslssvvtvpssslgtktytcnvdhkpsntkvdkrvesk ygppcppcpapeflggpsvflfppkpkdtlmisrtpevtcvvvdvsqedpe vqfnwyvdgvevhnakttkpreeqfnstyrvvsvltvlhqdwlngkeykck vsnkglpssiektiskakgqprepqvctlppsqeemtknqvslscavkgfyp sdiavewesngqpennykttppvldsdgsfflvskltvdksrwqegnvfscs vmhealhnhytqkslslslgk | SEQ ID NO: 432 |
| Light chain B | Dfvltqsphslsvtpgesasisckshslihgdrnnylawyvqkpgrspqlliylassr asgvpdrfsgsgsdkdftlkisrvetedvgtyycmqgrespwtfgqgtkvdikgqp kaapdivmtqtplslsvtpgqpasisckssqslvhnnantylswylqkpgqspqsliy kvsnrfsgvpdrfsgsgsgtdftlkisrveaedvgvyycgqgtqypftfgsgtkveikt kgpsrtvaapsvfifppsdeqlksgtasvcllnnfypreakvqwkvdnalqsgnsq esvteqdskdstyslsstltlskadyekhkvyacevthqglsspvtksfnrgec | SEQ ID NO: 433 |

Binding Protein 48 Nucleotide Sequences

| | | |
|---|---|---|
| Heavy chain A | caggtgcagctggtgcagtctggcgccgaggtcgtgaaacctggcgcctctgtgaagg tgtcctgcaaggccagcggctacacattaccagctactacatccactgggtgcgccag gcccctggacagggactggaatggatcggcagcatctaccccggcaacgtgaacacc aactacgcccagaagttccagggcagagccaccctgaccgtggacaccagcatcagc accgcctacatggaactgagccggctgagaagcgacgacaccgccgtgtactactgc acccggtcccactacggcctggattggaacttcgacgtgtggggcaagggcaccacc gtgacagtgtctagcgcgtcgaccaagggcccctcggtgttccctctggcccttgcag cagaagcaccagcgaatctacagccgccctgggctgcctcgtgaaggactactttccc gagcccgtgaccgtgtcctggaactctggcgctctgacaagcggcgtgcacacctttcc agccgtgctccagagcagcggcctgtactctctgagcagcgtcgtgacagtgcccagc agcagcctgggcaccaagacctacacctgtaacgtggaccacaagcccagcaacacc aaggtggacaagcgggtggaatctaagtacggcccctcctgccctccttgcccagcc ctgaatttctgggcggaccctccgtgttcctgttcccccaaagcccaaggacaccctga tgatcagccggaccccgaagtgacctgcgtggtggtggatgtgtcccaggaagatcc cgaggtgcagttcaattggtacgtggacgcgtggaagtgcacaacgccaagaccaa gcccagagaggaacagttcaacagcacctacccgggtggtgtccgtgctgaccgtgctg caccaggactggctgaacggcaaagagtacaagtgcaaggtgtccaacaagggcctg cccagctccatcgagaaaaccatcagcaaggccaagggccagccccgcgagcctca agtgtataccctgccccccttgccaggaagagatgaccaagaaccaggtgtccctgtggt gtctcgtgaaaggcttctacccccagcgacattgccgtggaatgggagagcaacggca gcccgagaacaactacaagaccacccccctgtgctggacagcgacggctcattcttc ctgtactccaagctgaccgtggacaagagccggtggcaggaaggcaacgtgttcagct gctccgtgatgcacgaggccctgcacaaccactacacccagaagtccctgtctctgtcc ctgggcaag | SEQ ID NO: 434 |
| Light chain A | gacatccagatgacccagagccccagcagcctgtctgccagcgtgggcgacagagtg accatcacctgtcaggccagcagaacatctacgtgtggctgaactggtatcagcagaa gcccggcaaggcccccaagctgctgatctacaaggccagcaacctgcacaccggcgt gcccagcagattactggcagcggctccggcaccgacttcaccctgacaatcagctccc tgcagccgaggacattgccacctactactgccagcagggccagacctaccctacac ctttggccagggcaccaagctggaaatcaagcgtacggtggccgctcccagcgtgttc atcttcccacctagcgacgagcagctgaagtccggcacagccttctgtcgtgtgcctgct gaacaacttctacccccgcgaggccaaggtgcagtgaaggtggacaatgccctgca gagcggcaacagccaggaaagcgtgaccgagcaggacagcaaggactccacctac agcctgagcagcaccctgaccctgagcaaggccgactacgagaagcacaaggtgtac gcctgcgaagtgacccaccaggcctgtctagccccgtgaccaagagcttcaaccgg ggcgagtgt | SEQ ID NO: 435 |
| Heavy chain B | caggtgcagctggtggaatctggcggcggagtggtgcagcctggcagaagcctgaga ctgagctgtgccgccagcggcttcaccttcaccaaggcctggatgcactgggtgcgcc aggcccctggaaagcagctggaatgggtggcccagatcaaggacaagagcaacagc tacgccacctactacgccgacagcgtgaagggccggttcaccatcagccgggacgac agcaagaacaccctgtacctgcagatgaacagcctgcgggccgaggacaccgccgtg tactactgtcggggcgtgtactatgccctgagcccttcgattactggggccagggaac cctcgtgaccgtgtctagtagccaggtgcacctgacacagagcggacccgaagtgcg gaagcctggcacctctgtgaaggtgtcctgcaaggcccctggcaacaccctgaaaacc tacgacctgcactgggtgcgcagcgtgccaggacagggactgcagtggatgggctgg atcagccacgagggcgacaagaaagtgatcgtggaacggttcaaggccaaagtgacc atcgactgggacagaagcaccaacaccgcctacctgcagctgagcggcctgacctctg gcgataccgccgtgtactactgcgccaagggcagcaagcaccggctgagagactacg | SEQ ID NO: 436 |

TABLE 2-continued

Heavy and light chain sequences of binding proteins. CDR sequences are bolded and italicized.

| | | |
|---|---|---|
| | ccctgtacgacgatgacggcgccctgaactgggccgtggatgtggactacctgagcaa cctggaattctgggccagggcacagccgtgaccgtgtcatctcggaccgccagcaca aagggcccatcggtgaccctctggcccttgcagcagaagcaccagcgaatctacag ccgccctgggctgcctcgtgaaggactactacccgagcccgtgaccgtgtcctggaac tctggcgctctgacaagcggcgtgcacacctttccagccgtgctccagagcagcggcc tgtactctctgagcagcgtcgtgacagtgcccagcagcagcctgggcacccaagaccta cacctgtaacgtggaccacaagcccagcaacaccaaggtggacaagcgggtggaatc taagtacggccctcctgccctccttgcccagcccctgaatactgggcgacccctccgt gttcctgttcccccaaagcccaaggacaccctgatgatcagccggaccccgaagtg acctgcgtggtggtggatgtgtcccaggaagatcccgaggtgcagttcaattggtacgt ggacggcgtggaagtgcacaacgccaagaccaagcccagagaggaacagttcaaca gcacctaccgggtggtgtccgtgctgaccgtgctgcaccaggactggctgaacggcaa agagtacaagtgcaaggtgtccaacaagggcctgcccagctccatcgagaaaaccatc agcaaggccaagggccagccccgcgagcctcaagtgtgtaccctgccccctagccag gaagagatgaccaagaaccaggtgtccctgagctgtgccgtgaaaggcttctacccca gcgacattgccgtggaatgggagagcaacggccagcccgagaacaactacaagacc accccccctgtgctggacagcgacggctcattcttcctggtgtccaagctgaccgtgga caagagccggtggcaggaaggcaacgtgacagctgctccgtgatgcacgaggccct gcacaaccactacacccagaagtccctgtctctgtccctgggcaag | |
| Light chain B | gacttcgtgctgacccagagccctcacagcctgagcgtgacacctggcgagaggcc agcatcagctgcaagagcagccactccctgatccacggcgacggaacaactacctg gcttggtacgtgcagaagcccggcagatccccccagctgctgatctacctggccagca gcagagccagcggcgtgcccgatagattactggcagcggcagcgacaaggacttca ccctgaagatcagccgggtggaaaccgaggacgtgggcacctactactgtatgcagg gcagagagcccctggacctaggccagggcaccaaggtggacatcaagggccag cccaaggccgccccgacatcgtgatgacccagaccccctgagcctgagcgtgaca cctggacagcctgccagcatcagctgcaagagcagcagagcctggtgcacaacaac gccaacacctacctgagctggtatctgcagaagcccggcagagccccagtccctga tctacaaggtgtccaacagattcagcggcgtgcccgacagattctccggcagcggctct ggcaccgacttcacccctgaagatcagcgggtggaagccgaggacgtgggcgtgtac tattgtggcagggcacccagtacccctcacctaggcagcggcaccaaggtggaaat caagaccaagggccccagccgtacggtggccgctcccagcgtgacatcttcccacct agcgacgagcagctgaagtccggcacagcctctgtcgtgtgcctgctgaacaacttcta ccccgcgaggccaaagtgcagtggaaggtggacaacgccctgcagagcggcaaca gccaggaaagcgtgaccgagcaggacagcaaggactccacctacagcctgagcagc accctgacactgagcaaggccgactacgagaagcacaaggtgtacgcctgcgaagtg acccaccagggcctgtctagccccgtgaccaagagcttcaaccggggcgagtgt | SEQ ID NO: 437 |

Binding Protein 49 Amino Acid Sequences

| | | |
|---|---|---|
| Heavy chain A | Qvqlvqsgaevvkpgasvkvsckasgytftsyyihwvrqapgqglewigsiypgn vntnyaqkfqgratltvdtsistaymelsrlrsddtavyyctrshygldwnfdvwgkg ttvtvssastkgpsvfplapcsrstsestaalgclvkdyfpepvtvswnsgaltsgvhtf pavlqssglyslssvvtvpssslgtktytcnvdhkpsntkvdkrveskygppcppcp apeflggpsvflfppkpkdtlmisrtpevtcvvvdvsqedpevqfnwyvdgvevh naktkpreeqfnstyrvvsvltvlhqdwlngkeykckvsnkglpssiektiskakgq prepqvytlppcqeemtknqvslwclvkgfypsdiavewesngqpennyktttpp vldsdgsfflysklvdksrwqegnvfscsvmhealhnhytqkslslslgk | SEQ ID NO: 438 |
| Light chain A | Diqmtqspsslsasvgdrvtltcqasqniyvwlnwyqqkpgkapklliykasnlht gvpsrfsgsgsgtdftltisslqpediatyycqqgqtypytfgqgtkleikrtvaapsvfi fppsdeqlksgtasvvcllnnfypreakvqwkvdnalqsgnsqesvteqdskdstys lsstltlskadyekhkvyacevthqglsspvtksfnrgec | SEQ ID NO: 439 |
| Heavy chain B | Qvqlvesgggvvqpgrslrlscaasgftftkawmhwvrqapgkqlewvaq inikdksnsyatyyadsvkgrftisrddskntlylqmnslraedtavyycrgvyy alspfdywgqgtlvtvsssqvhltqsgpevrkpgtsvkvsckapgntlk tydlhwvrsvpgqglqwmgwishegdkkviverfkakvtidwdrstntay lqlsgltsgdtavyycakgskhrlrdyalydddgalnwavdvdylsnlefwg qgtavtvssrtastkgpsvfplapcsrstsestaalgclvkdyfpepvtvs wnsgaltsgvhtfpavlqssglyslssvvtvpssslgtktytcnvdhkpsntkv dkrveskygppcppcpapeflggpsvflfppkpkdtlmisrtpevtcvvvd vsqedpevqfnwyvdgvevhnaktkpreeqfnstyrvvsvltvlhqdwln gkeykckvsnkglpssiektiskakgqprepqvctlppsqeemtknqvslsc avkgfypsdiavewesngqpennyktttppvldsdgsfflvskltvdksrwq egnvfscsvmhealhnhytqkslslslgk | SEQ ID NO: 440 |
| Light chain B | Dfvltqsphslsvtpgesasisckssshslihgdrnnylawyvqkpgrspqlliylassr asgvpdrfsgsgsdkdftlkisrvetedvgtyycmqgresptwfgqgtkvdikdkth tdivmtqtplslsvtpgqpasisckssqslvhnnantylswylqkpgqspqsliykvs nrfsgvpdrfsgsgsgtdftlkisrveadvgvyycgqgtqypftfgsgtkveikdkth trtvaapsvfifppsdeqlksgtasvcllnnfypreakvqwkvdnalqsgnsqesvt eqdskdstyslsstltlskadyekhkvyacevthqglsspvtksfnrgec | SEQ ID NO: 441 |

TABLE 2-continued

Heavy and light chain sequences of binding proteins. CDR sequences are bolded and italicized.

Binding Protein 49 Nucleotide Sequences

| | | |
|---|---|---|
| Heavy chain A | caggtgcagctggtgcagtctggcgccgaggtcgtgaaacctggcgcctctgtgaagg tgtcctgcaaggccagcggctacacctttaccagctactacatccactgggtgcgcag gcccctggacagggactggaatggatcggcagcatctaccccggcaacgtgaacacc aactacgcccagaagaccagggcagagccaccctgaccgtggacaccagcatcagc accgcctacatggaactgagccggctgagaagcgacgacaccgccgtgtactactgc acccggtcccactacggcctggattggaacttcgacgtgtggggcaagggcaccacc gtgacagtgtctagcgcgtcgaccaagggcccctcggtgttccctctggccccttgcag cagaagcaccagcgaatctacagccgccctgggctgcctcgtgaaggactactttccc gagcccgtgaccgtgtcctggaactctggcgctctgacaagcggcgtgcacacctacc agccgtgctccagagcagcggcctgtactctctgagcagcgtcgtgacagtgcccagc agcagcctgggcaccaagacctacacctgtaacgtggaccacaagcccagcaacacc aaggtggacaagcgggtggaatctaagtacggccctccctgccctccttgcccagccc ctgaatttctgggcggaccctccgtgttcctgttccccccaaagcccaaggacaccctga tgatcagccggaccccccgaagtgacctgcgtggtggtggatgtgtcccaggaagatcc cgaggtgcagttcaattggtacgtggacggcgtggaagtgcacaacgccaagaccaa gcccagagaggaacagttcaacagcacctaccgggtggtgtccgtgctgaccgtgctg caccaggactggctgaacggcaaagagtacaagtgcaaggtgtccaacaagggcctg cccagctccatcgagaaaaccatcagcaaggccaagggccagccccgcgagcctca agtgtataccctgcccccttgccaggaagagatgaccaagaaccaggtgtccctgtggt gtctcgtgaaaggcttctaccccagcgacattgccgtggaatgggagagcaacgccca gcccgagaacaactacaagaccacccccctgtgctggacagcgacggctcattcttc ctgtactccaagctgaccgtggacaagagccggtggcaggaaggcaacgtgttcagct gctccgtgatgcacgaggccctgcacaaccactacacccagaagtccctgtctctgtcc ctgggcaag | SEQ ID NO: 442 |
| Light chain A | gacatccagatgacccagagccccagcagcctgtctgccagcgtgggcgacagagtg accatcacctgtcaggccagcagaacatctacgtgtggctgaactggtatcagcagaa gcccggcaaggcccccaagctgctgatctacaaggccagcaacctgcacaccggcgt gcccagcagattttctggcagcggctccggcaccgacttcaccctgacaatcagctccc tgcagcccgaggacattgccacctactactgccagcagggccagaccacccctacac ctttggccagggcaccaagctggaaatcaagcgtacggtggccgctcccagcgtgttc atcttcccacctagcgacgagcagctgaagtccggcacagcctctgtcgtgtgcctgct gaacaacttctaccccgcgaggccaaggtgcagtggaaggtggacaatgccctgca gagcggcaacagccaggaaagcgtgaccgagcaggacagcaaggactccacctac agcctgagcagcaccctgaccctgagcaaggccgactacgagaagcacaaggtgtac gcctgcgaagtgacccaccagggcctgtctagccccgtgaccaagagcttcaaccgg ggcgagtgt | SEQ ID NO: 443 |
| Heavy chain B | caggtgcagctggtggaatctggcggcggagtggtgcagcctggcagaagcctgaga ctgagctgtgccgcagcggcttcaccttcaccaaggcctggatgcactgggtgcgcc aggcccctggaaagcagctggaatgggtggcccagatcaaggacaagagcaacagc tacgccacctactacgccgacagcgtgaagggccggttcaccatcagccgggacgac agcaagaacaccctgtacctgcagatgaacagcctgcgggccgaggacaccgccgtg tactactgtcggggcgtgtactatgccctgagccccttcgattactggggccagggaac cctcgtgaccgtgtctagtgacaaaacccataccaggtgcacctgacacagaggcgga cccgaagtgcgaagcctggcacctctgtgaaggtgtcctgcaaggcccctggcaaca ccctgaaaacctacgacctgcactgggtgcgcagcgtgccaggacagggactgcagt ggatgggctggatcagccacgagggcgacaagaaagtgatcgtggaacggttcaagg ccaaagtgaccatcgactgggacagaagcaccaacaccgcctacctgcagctgagcg gcctgacctctggcgataccgccgtgtactactgcgccaaggcgcaagcaccggct gagagactacgccctgtacgacgatgacggcgccctgaactgggccgtggatgtgga ctacctgagcaacctggaattctggggccagggcacagccgtgaccgtgtcatctgata gacccacaccgccagcacaaagggcccatcggtgttccctctggccccttgcagcag aagcaccagcgaatctacagccgccctgggctgcctcgtgaaggactactttcccgag cccgtgaccgtgtcctggaactctggcgctctgacaagcggcgtgcacacctttccagc cgtgctccagagcagcggcctgtactctctgagcagcgtcgtgacagtgcccagcagc agcctgggcaccaagacctacacctgtaacgtggaccacaagcccagcaacaccaag gtggacaagcgggtggaatctaagtacggccctccctgccctccttgcccagccccctga atttctgggcggaccctccgtgttcctgttccccccaaagcccaaggacaccctgatgat cagccggaccccccgaagtgacctgcgtggtggtggatgtgtcccaggaagatcccga ggtgcagttcaattggtacgtggacggcgtggaagtgcacaacgccaagaccaagcc cagagaggaacagttcaacagcacctaccgggtggtgtccgtgctgaccgtgctgcac caggactggctgaacggcaaagagtacaagtgcaaggtgtccaacaagggcctgccc agctccatcgagaaaaccatcagcaaggccaagggccagccccgcgagcctcaagt gtgtaccctgcccccctagccaggaagagatgaccaagaaccaggtgtccctgagctgt ggcgtgaaaggcttctaccccagcgacattgccgtggaatgggagagcaacggccag cccgagaacaactacaagaccacccccctgtgctggacagcgacggctcattcttcct ggtgtccaagctgaccgtggacaagagccggtggcaggaaggcaacgtgttcagctg ctccgtgatgcacgaggccctgcacaaccactacacccagaagtccctgtctctgtccct gggcaag | SEQ ID NO: 444 |
| Light chain B | gacttcgtgctgacccagagccctcacagcctgagcgtgacacctggcgagagcgcc agcatcagctgcaagagcagccactccctgatccacggcgaccggaacaactacctg gcttggtacgtgcagaagcccggcagatccccccagctgctgatctacctggccagca gcagagccagcggcgtgcccgatagattttctggcagcggcagcgacaaggacttca TABLE 2-continued Heavy and light chain sequences of binding proteins. CDR sequences are bolded and italicized.

```
ccctgaagatcagccgggtggaaaccgaggacgtgggcacctactactgtatgcagg
gcagagagagcccctggacctaggccagggcaccaaggtggacatcaaggacaaa
acccataccgacatcgtgatgacccagacccccctgagcctgagcgtgacacctggac
agcctgccagcatcagctgcaagagcagccagagcctggtgcacaacaacgccaaca
cctacctgagctggtatctgcagaagcccggccagagcccccagtccctgatctacaa
ggtgtccaacagattcagcggcgtgcccgacagattctcccggcagcggcctctggcacc
gacttcacccctgaagatcagccgggtggaagccgaggacgtgggcgtgtactattgt
gccagggcacccagtacccctt cacctaggcagcggcaccaaggtggaaatcaagg
ataagacccatacccgtacggtggccgctcccagcgtgacatcttcccacctagcgac
gagcagctgaagtccggcacagcctctgtcgtgtgcctgctgaacaacttctaccccg
cgaggccaaagtgcagtggaaggtggacaacgccctgcagagcggcaacagccag
gaaagcgtgaccgagcaggacagcaaggactccacctacagcctgagcagcaccct
gacactgagcaaggccgactacgagaagcacaaggtgtacgcctgcgaagtgaccca
ccagggcctgtctagccccgtgaccaagagcttcaaccggggcgagtgt
```

Binding Protein 50 Amino Acid Sequences

| | | |
|---|---|---|
| Heavy chain A | Qvqlqesgpglvkpsqtlsltctvsgfslsdygvhwvrqppgkglewlgviwaggg tnynpslksrktiskdtsknqvslklssvtaadtavyycardkgysyyysmdywgq gttvtvssastkgpsvfplapcsrstsestaalgclvkdyfpepvtvswnsgaltsgvht fpavlqssglyslssvvtvpssslgtktytcnvdhkpsntkvdkrveskygppcppc papeflggpsvflfppkpkdtlmisrtpevtcvvvdvsqedpevqfnwyvdgvev hnaktkpreeqfnstyrvvsvltvlhqdwlngkeykckvsnkglpssiektiskakg qprepqvytippcqeemtknqvslwclvkgfypsdiavewesngqpennykttp pvldsdgsfflyskltvdksrwqegnvfscsvmhealhnhytqkslslslgk | SEQ ID NO: 446 |
| Light chain A | Divltqspaslavspgqratitcrasesveyyvtslmqwyqqkpgqppkllifaasn vesgvparfsgsgsgtdftltinpveandvanyycqqsrkvpytfgqgtkleikrtvaa psvfifppsdeqlksgtasvvcllnnfypreakvqwkvdnalqsgnsqesvteqdsk dstyslsstltlskadyekhkvyacevthqglsspvtksfnrgec | SEQ ID NO: 447 |
| Heavy chain B | Qvhltqsgpevrkpgtsvkvsckapgntlktydlhwvrsvpgqglqwmg wishegdkkvviverfkakvtidwdrstntaylqlsgltsgdtavyycakgskh rlrdyalydddgalnwavdvdylsnlefwgqgtavtvsssqvqlvesgggv vqpgrslrlscaasgfttftkawmhwvrqapgkqlewvaqikdksnsyatyy adsvkgrftisrddskntlylqmnslraedtavyycrgvyyalspfdywgqgt lvtvssrtastkgpsvfplapcsrstsestaalgclvkdyfpepvtvswnsgalt sgvhtfpavlqssglyslssvvtvpssslgtktytcnvdhkpsntkvdkrvesk ygppcppcpapeflggpsvflfppkpkdtlmisrtpevtcvvvdvsqedpe vqfnwyvdgvevhnaktkpreeqfnstyrvvsvltvlhqdwlngkeykck vsnkglpssiektiskakgqprepqvctlppsqeemtknqvslscavkgfyp sdiavewesngqpennykttppvldsdgsfflvskltvdksrwqegnvfscs vmhealhnhytqkslslslgk | SEQ ID NO: 448 |
| Light chain B | Divmtqtplslsvtpgqpasiscksqqslvhnnantylswylqkpgqspqsliykvs nnrfsgvpdrfsgsgsgtdftlkisrveaedvgvyycgqgtqypftfgsgtkveikgpq kaapdfvltqsphslsvtpgesasisksksshslihgdrnnylawyvqkgrspqlliyl assrasgvpdrfsgsgsdkdftlkisrvetedvgtycmqgrespwtfgqgtkvdikt kgpsrtvaapsvfifppsdeqlksgtasvvcllnnfypreakvqwkvdnalqsgnsq esvteqdskdstyslsstltlskadyekhkvyacevthqglsspvtksfnrgec | SEQ ID NO: 449 |

Binding Protein 50 Nucleotide Sequences

| | | |
|---|---|---|
| Heavy chain A | caggtgcagctgcaggaatctggccctggcctcgtgaagcctagccagaccctgagcc tgacctgtaccgtgtccggcttcagcctgagcgactacggcgtgcactgggtgcgcca gccacctggaaaaggcctggaatggctgggcgtgatctgggctggcggaggcaccaa ctacaacccagcctgaagtccagaaagaccatcagcaaggacaccagcaagaacca ggtgtccctgaagctgagcagcgtgacagccgccgataccgccgtgtactactgcgcc agagacaagggctacagctactactacagcatggactactggggccagggcaccacc gtgaccgtgtcatccgcgtcgaccaagggcccctcggtgaccctctggccccttgcag cagaagcaccagcgaatctacagccgccctgggctgcctcgtgaaggactactaccc gagcccgtgaccgtgtcctggaactctggcgctctgacaagcggcgtgcacacctttcc agccgtgctccagagcagcggcctgtactctctgagcagcgtcgtgacagtgcccagc agcagcctgggcacccagacctacacctgtaacgtggaccacaagcccagcaacacc aaggtggacaagcgggtggaatctaagtacggccctccctgcccctccttgcccagcc ctgaatttctggggcggaccctccgtgttcctgttccccccaaagcccaaggacaccctga tgatcagccggaccccgaagtgacctgcgtggtggtggatgtgtcccaggaagatcc cgaggtgcagttcaattggtacgtggacggcgtggaagtgcacaacgccaagacgaa gcccagagaggaacagttcaacagcacctaccgggtggtgtccgtgctgaccgtgctg caccaggactggctgaacggcaaagagtacaagtgcaaggtgtccaacaagggcctg cccagctccatcgagaaaaccatcagcaaggccaagggccagccccgcgagcctca agtgtataccctgccccctccgcaggaagagatgaccaagaaccaggtgtccctgtggt gtctcgtgaaaggcttctacccagcgacattgccgtgaatgggagagcaacggca gcccgagaacaactacaagaccacccccctgtgctggacagcgacggctcattcttc ctgtactccaagctgaccgtggacaagagccggtggcaggaaggcaacgtgttcagct gctccgtgatgcacgaggccctgcacaaccactacacccagaagtccctgtctctgtcc ctgggcaag | SEQ ID NO: 450 |

TABLE 2-continued

Heavy and light chain sequences of binding proteins. CDR sequences are bolded and italicized.

| | | |
|---|---|---|
| Light chain A | gacatcgtgctgacacagagccctgctagcctggccgtgtctcctggacagagggcca ccatcacctgtagagccagcgagagcgtggaatattacgtgaccagcctgatgcagtg gtatcagcagaagcccggccagccccccaagctgctgattttcgccgccagcaacgtg gaaagcggcgtgccagccagattttccggcagcggctctggcaccgacttcaccctga ccatcaacccccgtggaagcaacgacgtggccaactactactgccagcagagccgga aggtgccctacacctttggccagggcaccaagctggaaatcaagcgtacggtggccgc tcccagcgtgttcatcttcccacctagcgacgagcagctgaagtccggcacagcctctgt cgtgtgcctgctgaacaacttctaccccgcgaggccaaggtgcagtggaaggtggac aatgccctgcagagcggcaacagccaggaaagcgtgaccgagcaggacagcaagg actccacctacagcctgagcagcaccctgaccctgagcaaggccgactacgagaagc acaaggtgtacgcctgcgaagtgacccaccagggcctgtctagccccgtgaccaaga gcttcaaccggggcgagtgt | SEQ ID NO: 451 |
| Heavy chain B | caggtgcacctgacacagagcggaccccgaagtgcggaagcctggcacctctgtgaag tgtcctgcaaggcccctggcaacaccctgaaaacctacgacctgcactgggtgcgca gcgtgccaggacagggactgcagtggatgggctggatcagccacgagggcgacaag aaaagtgatcgtggaacggttcaaggccaaagtgaccatcgactacagagaagcacc aacaccgcctacctgcagctgagcggcctgacctctggcgataccgccgtgtactactg cgccaagggcagcaagcaccggctgagagactacgccctgtacgacgatgacggcg ccctgaactgggccgtggatgtggactacctgagcaacctggaattctggggccaggg cacagccgtgaccgtgtcatcttctcaggtgcagctggtggaatctggcggcggagtg gtgcagcctggcagaagcctgagactgagctgtgccgccagcggcttcaccttcacca aggcctggatgcactgggtgcgccaggcccctggaaagcagctggaatgggtggccc agatcaaggacaagagcaacagctacgccacctactacgccgacagcgtgaagggc cggttcaccatcagccgggacgacagcaagaacacccctgtacctgcagatgaacagc ctgcgggccgaggacaccgccgtgtactactgtcggggcgtgtactatgccctgagcc ccttcgattactggggccagggaaccctcgtgaccgtgtctagtcggaccgcttcgacc aagggcccatcggtgttccctctgcccctttgcagcagaagcaccagcgaatctacag ccgccctgggctgcctcgtgaaggactactacccgagcccgtgaccgtgtcctggaac tctggcgctctgacaagcggcgtgcacacctttccagccgtgctccagagcagcggcc tgtactctctgagcagcgtcgtgacagtgccagcagcagcctgggcaccaagaccta cacctgtaacgtggaccacaagcccagcaacaccaaggtggacaagcgggtggaatc taagtacggccctcctgccctcttgcccagcccctgaatactgggcggaccctccgt gttcctgttccccccaaagcccaaggacacctgatgatcgcggacccccgaagtg acctgcgtggtggtggatgtgtcccaggaagatcccgaggtgcagttcaattggtacgt ggacggcgtggaagtgcacaacgccaagaccaagcccagagaggaacagttcaaca gcacctacgggtggtgtccgtgctgaccgtgctgcaccaggactggctgaacggcaa agagtacaagtgcaaggtgtccaacaaggcctgcccagctccatcgagaaaaccatc agcaaggccaagggccagccccgcgagcctcaagtgtgtaccctgcccccctagccag gaagagatgaccaagaaccaggtgtccctgagctgtgccgtgaaaggcttctacccca gcgacattgccgtggaatgggagagcaacggccagcccgagaacaactacaagacc acccccctgtgctggacagcgacggctcattcttcctggtgtccaagctgaccgtgga caagagccggtggcaggaaggcaacgtgacagctgctccgtgatgcacgaggccct gcacaaccactacacccagaagtccctgtctctgtccctgggcaag | SEQ ID NO: 452 |
| Light chain B | gacatcgtgatgacccagacccccctgagcctgagcgtgacacctggacagcctgcca gcatcagctgcaagagcagccagagcctggtgcacaacaacgccaacacctacctga gctggtatctgcagaagcccggccagagcccccagtccctgatctacaaggtgtccaa cagattcagcggcgtgcccgacagattctccggcagcggctctggcaccgacttcacc ctgaagatcagccgggtggaagccgaggacgtgggcgtgtactattgtggccagggc acccagtacccttcacctaggcagcggcaccaaggtggaaatcaagcgccagcgca aggccgcccccgacttcgtgctgacccagagccctcacagcctgagcgtgacacctg gcgagagcgccagcatcagctgcaagagcagccactccctgatccacggcgaccgg aacaactacctggcttggtacgtgcagaagcccggcagatcccccagctgctgatcta cctggccagcagagagccagcggcgtgcccgatagattttctggcagcggcagcga caaggacttcacccctgaagatcagccgggtggaaaccgaggacgtgggcacctacta ctgtatgcagggcagagagagcccctggacctaggccagggcaccaaggtggacat caagaccaagggccccagccgtacggtggccgctcccagcgtgttcatcttcccacct agcgacgagcagctgaagtccggcacagcctctgtcgtgtgcctgctgaacaacttcta ccccgcgaggccaaagtgcagtggaaggtggacaacgccctgcagagcggcaaca gccaggaaagcgtgaccgagcaggacagcaaggactccacctacagcctgagcagc accctgacactgagcaaggccgactacgagaagcacaaggtgtacgcctgcgaagtg acccaccagggcctgtctagccccgtgaccaagagcttcaaccggggcgagtgt | SEQ ID NO: 453 |

Binding Protein 51 Amino Acid Sequences

| | | |
|---|---|---|
| Heavy chain A | Qvqlqesgpgplvkpsqtlsltctvsgfslsdygvhwvrqppgkglewlgviwaggg tnynpslksrktiskdtsknqvslklssvtaadtavyycardkgysyyysmdywgq gttvtvssastkgpsvfplapcsrstsestaalgclvkdyfpepvtvswnsgaltsgvht fpavlqssglyslssvvtvpssslgtktytcnvdhkpsntkvdkrveskygppcppc papeflggpsvflfppkpkdtlmisrtpevtcvvvdvsqedpevqfnwyvdgvev hnaktkpreeqfnstyrvvsvltvlhqdwlngkeykckvsnkglpssiektiskakg qprepqvytippcqeemtknqvslwclvkgfypsdiavewesngqpennykttp pvldsdgsfflyskltvdksrwqegnvfscsvmhealhnhytqkslslslgk | SEQ ID NO: 454 |

TABLE 2-continued

Heavy and light chain sequences of binding proteins. CDR sequences are bolded and italicized.

| | |
|---|---|
| Light chain A | Divltqspaslavspgqratitcrasesveyyvtslmqwyqqkpgqppkllifaasn nvesgvparfsgsgsgtdftltinpveandvanyycqqsrkvpytfgqgtkleikrtvaa psvfifppsdeqlksgtasvvcllnnfypreakvqwkvdnalqsgnsqesvteqdsk dstyslsstltlskadyekhkvyacevthqglsspvtksfnrgec | SEQ ID NO: 455 |
| Heavy chain B | Qvhltqsgpevrkpgtsvkvsckapgntlktydlhwvrsvpgqglqwmg wishegdkkviverfkakvtidwdrstntaylqlsgltsgdtavyycakgskh rlrdyalydddgalnwavdvdylsnlefwgqgtavtvsssqvqlvesg ggvvqpgrslrlscaasgftftkawmhwvrqapgkqlewvaqikdksnsy atyyadsvkgrftisrddskntlylqmnslraedtavyycrgvyyalspfdyw gqgtlvtvssrtastkgpsvfplapcsrstsestaalgclvkdyfpepvtvs wnsgaltsgvhtfpavlqssglyslssvvtvpssslgtktytcnvdhkpsntkv dkrveskygppcppcpapeflgpsvflfppkpkdtlmisrtpevtcvvvd vsqedpevqfnwyvdgvevhnaktkpreeqfnstyrvvsvltvlhqdwln gkeykckvsnkglpssiektiskakgqprepqvctlppsqeemtknqvslsc avkgfypsdiavewesngqpennykttppvldsdgsfflvskltvdksrwq egnvfscsvmhealhnhytqkslslslgk | SEQ ID NO: 456 |
| Light chain B | Divmtqtplslsvtpgqpasiscksssqslvhnnantylswylqkpgqspqsliykvs nrfsgvpdrfsgsgsgtdftlkisrveaedvgvyycqqgtqypftfgsgtkveikdkth tdfvltqsphslsvtpgesasiscksshslihgdrnnylawyvqkgrspqlliylassr asgvpdrfsgsgsdkdftlkisrvetedvgtycmqgrespwtfgqgtkvdikdkth trtvaapsvfifppsdeqlksgtasvvcllnnfypreakvqwkvdnalqsgnsqesvt eqdskdstyslsstltlskadyekhkvyacevthqglsspvtksfnrgec | SEQ ID NO: 457 |

Binding Protein 51 Nucleotide Sequences

| | |
|---|---|
| Heavy chain A | caggtgcagctgcaggaatctggccctggcctcgtgaagcctagccagaccctgagcc tgacctgtaccgtgtccggcttcagcctgagcgactacgcgtgcactgggtgcgcca gccacctggaaaaggcctggaatggctgggcgtgatctgggctggcggaggcaccaa ctacaacccagcctgaagtccagaaagaccatcagcaaggactacagccagaagaacca ggtgtccctgaagctgagcagcgtgacagccgccgataccgccgtgtactactgcgcc agagacaagggctacagctactactacagcatggactactggggccagggcaccacc gtgaccgtgtcatccgcgtcgaccaagggccctcggtgaccctctggccccttgcag cagaagcaccagcgaatctacagccgccctgggctgcctcgtgaaggactactaccc gagcccgtgaccgtgtcctggaactctggcgctctgacaagcggcgtgcacacctacc agcccgtgctccagagcagcggcctgtactctctgagcagcgtcgtgacagtgcccagc agcagcctgggcaccaagacctacacctgtaacgtggaccacaagcccagcaacacc aaggtggacaagcgggtggaatctaagtacggccctccctgccctccttgcccagcc ctgaatttctgggcggaccctccgtgttcctgttccccccaaagcccaaggacaccctga tgatcagccggacccccgaagtgacctgcgtggtggtggatgtgtcccaggaagatcc cgaggtgcagttcaattggtacgtggacggcgtggaagtgcacaacgccaagaccaa gcccagagaggaacagttcaacagcacctaccgggtggtgtccgtgctgaccgtgctg caccaggactggctgaacggcaaagagtacaagtgcaaggtgtccaacaagggcctg cccagctccatcgagaaaaccatcagcaaggccaagggccagccccgcgagcctca agtgtataccctgcccccttgccaggaagagatgaccaagaaccaggtgtccctgtggt gtctcgtgaaaggcttctaccccagcgacattgccgtggaatgggagaacaacggcca gcccgagaacaactacaagaccacccccccctgtgctggacagcgacggctcattcttc ctgtactccaagctgaccgtggacaagagccggtggcaggaaggcaacgtgacagct gctccgtgatgcacgaggccctgcacaaccactacacccagaagtccctgtctctgtcc ctgggcaag | SEQ ID NO: 458 |
| Light chain A | gacatcgtgctgacacagagccctgctagcctggccgtgtctcctggacagagggcca ccatcacctgtagagccagcgagagcgtggaatattacgtgaccagcctgatgcagtg gtatcagcagaagcccggccagccccccaagctgctgattacgccgccagcaacgtg gaaagcggcgtgccagccgattaccggcagcggctctggcaccgacttcaccctga ccatcaaccccgtggaagccaacgacgtggccaactactactgccagcagagccgga aggtgccctacacctaggccagggcaccaagctgaaatcaagcgtacggtggccgc tcccagcgtgacatcttcccacctagcgacgagcagctgaagtccggcacagcctctgt cgtgtgcctgctgaacaacttctaccccgcgaggccaaggtgcagtggaaggtggac aatgccctgcagagcggcaacagccaggaaagcgtgaccgagcaggacagcaagg actccacctacagcctgagcagcaccctgaccctgagcaaggccgactacgagaagc acaaggtgtacgcctgcgaagtgacccaccagggcctgtctagccccgtgaccaaga gcttcaaccggggcgagtgt | SEQ ID NO: 459 |
| Heavy chain B | caggtgcacctgacacagagcggacccgaagtgcggaagcctggcacctctgtgaag gtgtcctgcaaggcccctggcaacaccctgaaaacctacgacctgcactgggtgcgca gcgtgccaggacagggactgcagtggatgggctggatcagccacgagggcgacaag aaagtgatcgtggaacggttcaaggccaaagtgaccatcgactgggacagaagcacc aacaccgcctacctgcagctgagcggcctgaccctctggcgataccgccgtgtactactg cgccaagggcagcaagcaccggctgagagactacgccctgtacgacgatgacggcg ccctgaactgggccgtggatgtggactacctgagcaacctggaattctggggccaggg cacagccgtgaccgtgtcatcgacaaaacccataccaggtgcagctggtggaatctg gcggcggagtggtgcagcctggcagaagcctgagactgagctgtgccgcagcggc ttcaccttcaccaaggcctggatgcactgggtgcgccaggcccctggaaagcagctgg aatgggtggcccagatcaaggacaagagcaacagctacgccacctactacgccgaca gcgtgaagggccggttcaccatcagccgggacgacagcaagaacaccctgtacctgc | SEQ ID NO: 460 |

TABLE 2-continued

Heavy and light chain sequences of binding proteins. CDR sequences are bolded and italicized.

| | | |
|---|---|---|
| | agatgaacagcctgcgggccgaggacaccgccgtgtactactgtcggggcgtgtacta tgccctgagccccttcgattactggggccagggaaccctcgtgaccgtgtctagtgataa gacccacaccgcttcgaccaagggcccatcggtgttccctctggcccttgcagcaga agcaccagcgaatctacagccgccctgggctgcctcgtgaaggactactttcccgagc ccgtgaccgtgtcctggaactctggcgctctgacaagcggcgtgcacacctttccagcc gtgctccagagcagcggcctgtactctctgagcagcgtcgtgacagtgcccagcaga gcctgggcaccaagacctacacctgtaacgtggaccacaagcccagcaacaccaagg tggacaagcgggtggaatctaagtacggcccccctgccctccttgcccagcccctgaa tttctgggcggaccctccgtgttcctgttcccccccaaagcccaaggacaccctgatgatc agccggacccccgaagtgacctgcgtggtggtggatgtgtcccaggaagatcccgag gtgcagttcaattggtacgtggacggcgtggaagtgcacaacgccaagaccaagccca gagaggaacagttcaacagcacctaccgggtggtgtccgtgctgaccgtgctgcacca ggactggctgaacggcaaagagtacaagtgcaaggtgtccaacaaggcctgcccag ctccatcgagaaaaccatcagcaaggccaagggccagccccgcgagcctcaagtgtg taccctgccccctagccaggaagagatgaccaagaaccaggtgtccctgagctgtgcc gtgaaaggcttctaccccagcgacattgccgtggaatgggagagcaacggccagccc gagaacaactacaagaccacccccctgtgctggacagcgacggctcattcttcctggt gtccaagctgaccgtggacaagagccggtggcaggaaggcaacgtgttcagctgctc cgtgatgcacgaggccctgcacaaccactacacccagaagtccctgtctctgtccctgg gcaag | |
| Ligh chain B | tgacatcgtgatgacccagacccccctgagcctgagcgtgacacctggacagcctgcca gcatcagctgcaagagcagccagagcctggtgcacaacaacgccaacacctacctga gctggtatctgcagaagcccggccagagcccccagtccctgatctacaaggtgtccaa cagattcagcggcgtgcccgacagattctccggcagcggctctggcaccgacttcacc ctgaagatcagccgggtggaagccgaggacgtgggcgtgtactattgtggccagggc acccagtaccccttcacctttggcagcggcaccaaggtggaaatcaaggacaaaaccc ataccgacttcgtgctgacccagagccctcacagcctgagcgtgacacctggcgagag cgccagcatcagctgcaagagcagccactccctgatccacggcgaccggaacaacta cctggcttggtacgtgcagaagcccggcagatccccccagctgctgatctacctggcca gcagcagagccagcggcgtgcccgatagatttctggcagcggcgacaaggact tcaccctgaagatcagccgggtggaaaccgaggacgtgggcacctactactgtatgca gggcagagaagcccctggaccttttggccagggcaccaaggtggacatcaaggataa gacccataccgtacggtggccgctcccagcgtgttcatcttcccacctagcgacgagc agctgaagtccggcacagcctctgtcgtgtgcctgctgaacaacttctaccccccgcgag gccaaagtgcagtggaaggtggacaacgccctgcagagcggcaacagccaggaaa gcgtgaccgagcaggacagcaaggactccacctacagcctgagcagcaccctgaca ctgagcaaggccgactacgagaagcacaaggtgtacgcctgcgaagtgacccaccag ggcctgtctagccccgtgaccaagagcttcaaccggggcgagtgt | SEQ ID NO: 461 |

Binding Protein 52 Amino Acid Sequences

| | | |
|---|---|---|
| Heavy chain A | Qvqlqesgpglvkpsqtlsltctvsgfslsdygvhwvrqppgkglewlgviwaggg ntnynpslksrktiskdtsknqvslklssvtaadtavyycardkgysyyysmdywgq gttvtvssastkgpsvfplapcsrstsestaalgclvkdyfpepvtvswnsgaltsgvht fpavlqssglyslssvvtvpssslgtktytcnvdhkpsntkvdkrveskygppcppc papeflggpsvflfppkpkdtlmisrtpevtcvvvdvsqedpevqfnwyvdgvev hnaktkpreeqfnstyrvvsvltvlhqdwlngkeykckvsnkglpssiektiskakg qprepqvytippcqeemtknqvslwclvkgfypsdiavewesngqpennykttp pvldsdgsfflysklvdksrwqegnvfscsvmhealhnhytqkslslslgk | SEQ ID NO: 462 |
| Light chain A | Divltqspaslavspgqratitcrasesveyyvtslmqwyqqkpgqppkllifaasn vesgvparfsgsgsgtdftltinpveandvanyycqqsrkvpytfggqtkleikrtvaa psvfifppsdeqlksgtasvvcllnnfypreakvqwkvdnalqsgnsqesvteqdsk dstyslsstltlskadyekhkvyacevthqglsspvtksfnrgec | SEQ ID NO: 463 |
| Heavy chain B | Qvqlvesgggvvqpgrslrlscaasgftftkawmhwvrqapgkqlewvaq inikdksnsyatyyadsvkgrftisrddskntlylqmnslraedtavyycrgvyy alspfdywgqgtlvtvsssqvhltqsgpevrkpgtsvkvsckapgntlktydl hwvrsvpgqglqwmgwishegdkkviverfkakvtidwdrstntaylqls gltsgdtavyycakgskhrlrdyalydddgalnwavdvdylsnlefwgqgt avtvssrtastkgpsvfplapcsrstsestaalgclvkdyfpepvtvswnsgalt sgvhtfpavlqssglyslssvvtvpssslgtktytcnvdhkpsntkvdkrvesk ygppcppcpapeflggpsvflfppkpkdtlmisrtpevtcvvvdvsqedpe vqfnwyvdgvevhnaktkpreeqfnstyrvvsvltvlhqdwlngkeykck vsnkglpssiektiskakgqprepqvctlppsqeemtknqvslscavkgfyp sdiavewesngqpennykttppvldsdgsfflvskltvdksrwqegnvfscs vmhealhnhytqkslslslgk | SEQ ID NO: 464 |
| Light chain B | Dfvltqsphslsvtpgesasiscksshslihgdrnnylawyvqkpgrspqlliylassr sgvpdrfsgsgsdkdftlkisrvetedvgtyycmqgrespwtfggqtkvdikgqp kaapdivmtqtplslsvtpgqpasiscksssqslvhnnantylswylqkpgqspqsliy kvsnrfsgvpdrfsgsgsgtdftlkisrveaedvgvyycgqgtqypftfgsgtkveikt kgpsrtvaapsvfifppsdeqlksgtasvcllnnfypreakvqwkvdnalqsgnsq esvteqdskdstyslsstltlskadyekhkvyacevthqglsspvtksfnrgec | SEQ ID NO: 465 |

TABLE 2-continued

Heavy and light chain sequences of binding proteins. CDR sequences are bolded and italicized.

Binding Protein 52 Nucleotide Sequences

| | | |
|---|---|---|
| Heavy chain A | caggtgcagctgcaggaatctggccctggcctcgtgaagcctagccagaccctgagcc tgacctgtaccgtgtccggcttcagcctgagcgactacgccgtgcactgggtgcgcca gccacctggaaaaggcctggaatggctgggcgtgatctgggctggcggaggcaccaa ctacaacccagcctgaagtccagaaagaccatcagcaaggacaccagcaagaacca ggtgtccctgaagctgagcagcgtgacagccgccgataccgccgtgtactactgcgcc agagacaagggctacagctactactacagcatggactactggggccagggcaccacc gtgaccgtgtcatccgcgtcgaccaagggcccctcggtgttccctctggcccccttgcag cagaagcaccagcgaatctacagccgccctgggctgcctcgtgaaggactactttccc gagcccgtgaccgtgtcctggaactctggcgctctgacaagcggcgtgcacacctttcc agccgtgctccagagcagcggcctgtactctctgagcagcgtcgtgacagtgcccagc agcagcctgggcaccaagacctacacctgtaacgtggaccacaagcccagcaacacc aaggtggacaagcgggtggaatctaagtacggccctcctgccctccttgcccagccc ctgaatttctggggcggaccctccgtgttcctgttcccccaaagcccaaggacaccctga tgatcagccggaccccgaagtgacctgcgtggtggtggatgtgtcccaggaagatcc cgaggtgcagttcaattggtacgtggacggcgtggaagtgcacaacgccaagaccaa gcccagagaggaacagttcaacagcacctacccgggtggtgtccgtgctgaccgtgctg caccaggactggctgaacggcaaagagtacaagtgcaaggtgtccaacaagggcctg cccagctccatcgagaaaaccatcagcaaggccaagggccagccccgcgagcctca agtgtataccctgccccttgccaggaagagatgaccaagaaccaggtgtccctgtggt gtctcgtgaaaggcttctaccccagcgacattgccgtggaatgggagagcaacggcca gccgagaacaactacaagaccacccccctgtgctggacagcgacggctcattcttc ctgtactccaagctgaccgtggacaagagccggtggcaggaaggcaacgtgttcagct gctccgtgatgcacgaggccctgcacaaccactacacccagaagtccctgtctctgtcc ctgggcaag | SEQ ID NO: 466 |
| Light chain A | gacatcgtgctgacacagagccctgctagcctggccgtgtctcctggacagagggcca ccatcacctgtagagccagcgagagcgtggaatattacgtgaccagcctgatgcagtg gtatcagcagaagcccggccagcccccaagctgctgattttcgccgccagcaacgtg gaaagcggcgtgccagccagattttccggcagcggctctggcacagagccgga ccatcaaccccgtggaagcaacgacgtggccaactactactgccagcagagccgga aggtgccctacaccttggccagggcaccaagctggaaatcaagcgtacggtggccgc tcccagcgtgttcatcttcccacctagcgacgagcagctgaagtccggcacagcctctgt cgtgtgcctgctgaacaacttctaccccgcgaggccaaggtgcagtggaaggtggac aatgccctgcagagcggcaacagccaggaaagcgtgaccgagcaggacagcaagg actccacctacagcctgagcagcaccctgaccctgagcaaggccgactacgagaagc acaaggtgtacgcctgcgaagtgacccaccagggcctgtctagccccgtgaccaaga gcttcaaccggggcgagtgt | SEQ ID NO: 467 |
| Heavy chain B | caggtgcagctggtggaatctggcggcggagtggtgcagcctggcagaagcctgaga ctgagctgtgccgcagcggcttcaccttccaccaaggcctggatgcactgggtgcgcc aggccctggaaagcagctggaatgggtggcccagatcaaggacaagagcaacagc tacgccacctactacgccgacagcgtgaagggccggacaccatcagccgggacgac agcaagaacaccctgtacctgcagatgaacagcctgcgggccgaggacaccgccgtg tactactgtcggggcgtgtactatgccctgagccccttcgattactggggccagggaac cctcgtgaccgtgtctagtagccaggtgcacctgacacagagcggaccgaagtgcg gaagcctggcacctctgtgaaggtgtcctgcaaggcccctggcaacaccctgaaaacc tacgacctgcactgggtgcgcagcgtgccaggacagggactgcagtggatgggctgg atcagccacgagggcgacaagaaagtgatcgtggaacggttcaaggccaaagtgacc atcgactgggacagaagcaccaacaccgcctacctgcagctgagcggcctgacctctg gcgataccgccgtgtactactgcgccaagggcagcaagcaccggctgagagactacg ccctgtacgacgatgacggcgccctgaactgggcgtggatgtggactacctgagcaa cctggaattctggggccagggcacagccgtgaccgtgtcatctcggaccgccagcaca aagggcccatcggtgaccctctggcccccttgcagcagaagcaccagcgaatctacag ccgcctgggctgcctcgtgaaggactactttcccgagcccgtgaccgtgtcctggaac tctggcgctctgacaagcggcgtgcacacctttccagccgtgctccagagcagcggcc tgtactctctgagcagcgtcgtgacagtgcccagcagcagcctgggcaccaagaccta cacctgtaacgtggaccacaagcccagcaacaccaaggtggacaagcgggtggaatc taagtacggccctcctgccctccttgcccagccctgaatttctggggcggacccctccgt gttcctgttcccccaaagcccaaggacaccctgatgatcagccggaccccgaagtg acctgcgtggtggtggatgtgtcccaggaagatcccgaggtgcagttcaattggtacgt ggacggcgtggaagtgcacaacgccaagaccaagcccagagaggaacagttcaaca gcacctacccgggtggtgtccgtgctgaccgtgctgcaccaggactggctgaacggcaa agagtacaagtgcaaggtgtccaacaagggcctgcccagctccatcgagaaaaccatc agcaaggccaagggccagccccgcgagcctcaagtgtataccctgccccctagccag gaagagatgaccaagaaccaggtgtccctgagctgtgccgtgaaaggcttctacccca gcgacattgccgtggaatgggagagcaacggccagcccgagaacaactacaagacc accccctgtgctggacagcgacggctcattcttcctggtgtccaagctgaccgtgga caagagccggtggcaggaaggcaacgtgacagctgctccgtgatgcacgaggccct gcacaaccactacacccagaagtccctgtctctgtccctgggcaag | SEQ ID NO: 468 |
| Light chain B | gacttcgtgctgacccagagccctcacagcctgagcgtgacacctggcgagagcgcc agcatcagctgcaagagcagccactccctgatccacggcgaccggaacaactacctg gcttggtacgtgcagaagcccggcagatcccccagctgctgatctacctggccagca gcttgagccagcggcgtgcccgatagattactggcagcggcagcgacaaggacttca ccctgaagatcagccgggtggaaaccgaggacgtgggcacctactactgtatgcagg | SEQ ID NO: 469 |

TABLE 2-continued

Heavy and light chain sequences of binding proteins. CDR sequences are bolded and italicized.

```
gcagagagagcccctggacctaggccagggcaccaaggtggacatcaagggccag
cccaaggccgccccgacatcgtgatgacccagacccccctgagcctgagcgtgaca
cctggacagcctgccagcatcagctgcaagagcagccagagcctggtgcacaacaac
gccaacacctacctgagctggtatctgcagaagcccggccagagcccccagtccctga
tctacaaggtgtccaacagattcagcggcgtgcccgacagattctccggcagcggctct
ggcaccgacttcacccctgaagatcagccgggtggaagccgaggacgtgggcgtgtac
tattgtggccagggcacccagtacccccttcacctttggcagcggcaccaaggtggaaat
caagaccaagggccccagccgtacggtggccgctcccagcgtgttcatcttcccacct
agcgacgagcagctgaagtccggcacagcctctgtcgtgtgcctgctgaacaacttcta
ccccgcggaggccaaagtgcagtggaaggtggacaacgccctgcagagcggcaaca
gccaggaaagcgtgaccgagcaggacagcaaggactccacctacagcctgagcagc
accctgacactgagcaaggccgactacgagaagcacaaggtgtacgcctgcgaagtg
acccaccagggcctgtctagccccgtgaccaagagcttcaaccggggcgagtgt
```

Binding Protein 53 Amino Acid Sequences

| | | |
|---|---|---|
| Heavy chain A | Qvqlqesgpglvkpsqtlsltctvsgfslsdygvhwvrq*ppgkglewlgviwaggg chaintnynpslksrktiskdtsknqvslklssvtaadtavyycardkgsyyyysmdywgq* gttvtvssastkgpsvfplapcsrstsestaalgclvkdyfpepvtvswnsgaltsgvht fpavlqssglyslssvvtvpssslgtktytcnvdhkpsntkvdkrveskygppcppc papeflggpsvflfppkpkdtlmisrtpevtcvvvdvsqedpevqfnwyvdgvev hnaktkpreeqfnstyrvvsvltvlhqdwlngkeykckvsnkglpssiektiskakg qprepqvytippcqeemtknqvslwclvkgfypsdiavewesngqpennykttp pvldsdgsfflysklltvdksrwqegnvfscsvmhealhnhytqkslslslgk | SEQ ID NO: 470 |
| Light chain A | Divltqspaslavspgqratitcrasesveyyvtslmqwyqqkpgqppkllifaasn chainvesgvparfsgsgsgtdftltinpveandvanyycqqsrkvpytfgqgtkleikrtvaa psvfifppsdeqlksgtasvvcllnnfypreakvqwkvdnalqsgnsqesvteqdsk dstyslsstltlskadyekhkvyacevthqglsspvtksfnrgec | SEQ ID NO: 471 |
| Heavy chain B | Qvqlvesggggvvqpgrslrlscaasgftftkawmhwvrqapgkqlewvaq chainikdksnsyatyyadsvkgrftisrddskntlylqmnslraedtavyycrgvyy alspfdywgqgtlvtvsssqvhltqsgpevrkpgtsvkvsckapgntlk tydlhwvrsvpgqglqwmgwishegdkkviverfkakvtidwdrstntay lqlsgltsgdftavyycakgskhrlrdyalydddgalnwavdvdylsnlefwg qgtavtvssrtastkgpsvfplapcsrstsestaalgclvkdyfpepvtvs wnsgaltsgvhtfpavlqssglyslssvvtvpssslgtktytcnvdhkpsntkv dkrveskygppcppcpapeflggpsvflfppkpkdtlmisrtpevtcvvvd vsqedpevqfnwyvdgvevhnaktkpreeqfnstyrvvsvltvlhqdwln gkeykckvsnkglpssiektiskakgqprepqvctlppsqeemtknqvslsc avkgfypsdiavewesngqpennykttppvldsdgsfflvskltvdksrwq egnvfscsvmhealhnhytqkslslslgk | SEQ ID NO: 472 |
| Light chain B | Dfvltqsphslsvtpgesasiscksshslihgdrnnylawyvqkpgrspqlliylassr chainasgvpdrfsgsgsdkdftlkisrvetedvgtyycmqgrespwtfgqgtkvdikdkth tdivmtqtplslsvtpgqpasisckssqslvhnnantylswylqkpgqspqsliykvs nrfsgvpdrfsgsgsgtdftlkisrveadvgvyycgqgtqypftfgsgtkveikdkth trtvaapsvfifppsdeqlksgtasvcllnnfypreakvqwkvdnalqsgnsqesvt eqdskdstyslsstltlskadyekhkvyacevthqglsspvtksfnrgec | SEQ ID NO: 473 |

Binding Protein 53 Nucleotide Sequences

| | | |
|---|---|---|
| Heavy chain A | caggtgcagctgcaggaatctggccctggcctcgtgaagcctagccagaccctgagcc tgacctgtaccgtgtccggcttcagcctgagcgactacgccgtgcactgggtgcgcca gccacctggaaaaggcctggaatggctgggcgtgatctgggctggcggaggcaccaa ctacaacccccagcctgaagtccagaaagaccatcagcaaggacaccagcaagaacca ggtgtccctgaagctgagcagcgtgacagccgccgataccgccgtgtactactgcgcc agagacaagggctacagctactactacagcatggactactggggccagggcaccacc gtgaccgtgtcatccgcgtcgaccaagggcccctcggtgaccctctggccccttgcag cagaagcaccagcgaatctacagccgccctgggctgcctcgtgaaggactactttccc gagcccgtgaccgtgtcctggaactctggcgctctgacaagcggcgtgcacacctacc agccgtgctccagagcagcggcctgtactctctgagcagcgtcgtgacagtgcccagc agcagcctgggcaccaagacctacacctgtaacgtggaccacaagcccagcaacacc aaggtggacaagcgggtggaatctaagtacggccctccctgccctccttgcccagccc ctgaatactgggcggacccctccgtgttcctgttcccccaaagcccaaggacaccctga tgatcagccggaccccccgaagtgacctgcgtggtggtggatgtgtcccaggaagatcc cgaggtgcagttcaattggtacgtggacggcgtggaagtgcacaacgccaagaccaa gcccagagaggaacagttcaacagcacctacccgggtggtgtccgtgctgaccgtgctg caccaggactggctgaacggcaaagagtacaagtgcaaggtgtccaacaagggcctg cccagctccatcgagaaaaccatcagcaaggccaagggccagccccgcgagcctca agtgtatacctgcccccttgccaggaagagatgaccaagaaccaggtgtccctgtggt gtctcgtgaaggcttctacccagcgacattgccgtgaatgggagcaagcaactga cccgagaacaactacaagaccacccccctgtgctggacagcgacggctcattcttc ctgtactccaagctgaccgtggacaagagccggtggcaggaaggcaacgtgacagct gctccgtgatgcacgaggccctgcacaaccactacacccagaagtccctgtctctgtcc ctgggcaag | SEQ ID NO: 474 |

TABLE 2-continued

Heavy and light chain sequences of binding proteins. CDR sequences are bolded and italicized.

| | | |
|---|---|---|
| Light chain A | gacatcgtgctgacacagagccctgctagcctggccgtgtctcctggacagagggcca ccatccacctgtagagccagcgagagcgtggaatattacgtgaccgcctgatgcagtg gtatcagcagaagcccggccagcccccaagctgctgattttcgccgccagcaacgtg gaaagcggcgtgccagccagattttccggcagcggctctggcaccgacttcaccctga ccatcaaccccgtggaagccaacgacgtggccaactactactgccagcagagccgga aggtgccctacaccttggccagggcaccaagctggaaatcaagcgtacggtggccgc tcccagcgtgttcatcttcccacctagcgacgagcagctgaagtccggcacagcctctgt cgtgtgcctgctgaacaacttctaccccgcgaggccaaggtgcagtggaaggtggac aatgccctgcagagcggcaacagccaggaaagcgtgaccgagcaggacagcaagg actccacctacagcctgagcagcaccctgaccctgagcaaggccgactacgagaagc acaaggtgtacgcctgcgaagtgacccaccagggcctgtctagccccgtgaccaaga gcttcaaccggggcgagtgt | SEQ ID NO: 475 |
| Heavy chain B | caggtgcagctggtggaatctggcggcggagtggtgcagcctggcagaagcctgaga ctgagctgtgccgccagcggcttcaccttcaccaaggcctggatgcactgggtgcgcc aggcccctggaaagcagctggaatgggtggcccagatcaaggacaagagcaacagc tacgccacctactacgccgacagcgtgaagggccggttcaccatcagccgggacgac agcaagaacaccctgtacctgcagatgaacagctgcgggccaggacccgccgtg tactactgtcggggcgtgtactatgccctgagcccttcgattactgggcagggaac cctcgtgaccgtgtctagtgacaaaacccatacccaggtgcacctgacacagagcgga cccgaagtgcggaagcctggcacctctgtgaaggtgtcctgcaaggcccctggcaaca ccctgaaaacctacgacctgcactgggtgcgcagcgtgccaggacagggactgcagt ggatgggctggatcagccacgagggcgacaagaaagtgatcgtgaacggttcaagg ccaaagtgaccatcgactgggacagaagcaccaacaccgcctacctgcagctgagcg gcctgacctctggcgataccgccgtgtactactgcgccaagggcagcaagcaccggct gagagactacgccctgtacgacgatgacggcgccctgaactgggccgtggatgtgga ctacctgagcaacctggaattctggggcagggcacagccgtgaccgtgtcatctgata gacccacaccgccagcacaaaggccatcggtgttccctctggcccttgcagcag aagcaccagcgaatctacagccgccctgggctgcctcgtgaaggactactttcccgag cccgtgaccgtgtcctggaactctggcgctctgacaagcggcgtgcacacctttccagc cgtgctccagagcagcggcctgtactctctgagcagcgtgacagtgcccagcagc agcctgggcaccaagacctacacctgtaacgtggaccacaagcccagcaacaccaag gtggacaagcgggtggaatctaagtacggcccctcctgccctccttgcccagcccctga atttctggggcgaccctcgtgttcctgttccccccaaagcccaaggacaccctgatgat cagccggaccccgaagtgacctgcgtggtggtggatgtgtcccaggaagatcccga ggtgcagttcaattggtacgtggacggcgtggaagtgcacaacgccaagaccaagcc cagagaggaacagttcaacagcacctaccgggtggtgtccgtgctgaccgtgctgcac caggactggctgaacggcaaagagtacaagtgcaaggtgtccaacaagggcctgccc agctccatcgagaaaaccatcagcaaggccaagggccagccccgcgagcctcaagt gtgtaccctgcccctagccaggaagagatgaccaagaaccaggtgtccctgagctgt gccgtgaaaggcttctaccccagcgacattgccgtggaatgggagagcaacggccag cccgagaacaactacaagacccaccccctgtgctggacagcgacggctcattcttcct ggtgtccaagctgaccgtggacaagagccggtggcaggaaggcaacgtgttcagctg ctccgtgatgcacgaggccctgcacaaccactacacccagaagtccctgtctctgtccct gggcaag | SEQ ID NO: 476 |
| Light chain B | gacttcgtgctgacccagagccctcacagcctgagcgtgacacctggcgagagcgcc agcatcagctgcaagagcagccactccctgatccacggcgaccggaacaactacctg gcttggtacgtgcagaagcccggcagatccccccagctgctgatctacctggccagca gcagagccagcggcgtgcccgatagatttctggcagcggcagcgacaaggacttca ccctgaagatcagccgggtggaaaccgaggacgtgggcacctactactgtatgcagg gcagagagagccccctggaccttggccagggcaccaaggtggacatcaaggacaaa accatacgacatcgtgatgacccagaccccctgagcctgagcgtgacacctggac agcctgccagcatcagctgcaagagcagcagagcctggtcacaacaacgccaaca cctacctgagctggtatctgcagaagcccggccagccccagtccctgatctacaa ggtgtccaacagattcagcggcgtgcccgacagattctccggcagcggctctggcacc gacttcaccctgaagatcagccgggtggaagccgaggacgtgggcgtgtactattgtg gccagggcacccagtacccttcacctttggcagcggcaccaaggtggaaatcaagg ataagacccataccgtacggtggccgctcccagcgtgttcatcttcccacctagcgac gagcagctgaagtccggcacagcctctgtcgtgtgcctgctgaacaacttctaccccg cgaggccaaagtgcagtggaaggtggacaacgccctgcagagcggcaacagccag gaaagcgtgaccgagcaggacagcaaggactccacctacagcctgagcagcaccct gacactgagcaaggccgactacgagaagcacaaggtgtacgcctgcgaagtgaccca ccagggcctgtctagccccgtgaccaagagcttcaaccggggcgagtgt | SEQ ID NO: 477 |

TABLE A

CDR sequences of binding proteins

| Ab | CDRH1 | CDRH2 | CDRH3 |
|---|---|---|---|
| CD4BS "a" | dctin (SEQ ID NO: 248) | wlkprggavnyarpl qg (SEQ ID NO: 249) | gkncdynwdfeh (SEQ ID NO: 250) |

TABLE A-continued

CDR sequences of binding proteins

| | | | |
|---|---|---|---|
| CD4BS "b" | GYFTAHI (SEQ ID NO: 251) | IKPQYGAV (SEQ ID NO: 252) | drsygdsswalda (SEQ ID NO: 253) |
| MPER | gfdfdnaw (SEQ ID NO: 254) | itgpgegwsv (SEQ ID NO: 255) | tgkyydfwsgyppgeeyfqd (SEQ ID NO: 256) |
| V1/V2 dir. "a" | GNTLKTYD (SEQ ID NO: 257) | ISHEGDKK (SEQ ID NO: 258) | cakgskhrlrdyalyddd galnwavdvdylsnlefw (SEQ ID NO: 259) |
| V3 dir. | SGASISDSY (SEQ ID NO: 260) | VHKSGDT (SEQ ID NO: 261) | ARTLHGRRIYGIVAFNEWFT YFYMDV (SEQ ID NO: 262) |
| V1/V dir. "b" | QFRFDGYG (SEQ ID NO: 263) | ISHDGIKK (SEQ ID NO: 264) | CAKDLREDECEEWWSDYYDF GKQLPCAKSRGGLVGIADNW (SEQ ID NO: 265) |
| Anti-CD28 | GYTFTSYY (SEQ ID NO: 479) | IYPGNVNT (SEQ ID NO: 480) | trshygldwnfdv (SEQ ID NO: 481) |
| Anti-CD28 | GFSLSDYG (SEQ ID NO: 482) | IWAGGGT (SEQ ID NO: 483) | ardkgysyyysmd (SEQ ID NO: 484) |
| Anti-CD3 | GFTFTKAW (SEQ ID NO: 485) | IKDKSNS (SEQ ID NO: 486) | rgvyyalspfdy (SEQ ID NO: 487) |
| Ab | CDRL1 | CDRL2 | CDRL3 |
| CD4BS "a" | rtsqygsla (SEQ ID NO: 266) | sgstraa (SEQ ID NO: 267) | qqyef (SEQ ID NO: 268) |
| CD4BS "b" | QGVGSD (SEQ ID NO: 269) | HTS (SEQ ID NO: 270) | qvlqf (SEQ ID NO: 271) |
| MPER | rgdslrshyas (SEQ ID NO: 272) | gknnrps (SEQ ID NO: 273) | ssrdksgsrlsv (SEQ ID NO: 274) |
| V1/V2 dir. "a" | hslihgdrnny (SEQ ID NO: 275) | las (SEQ ID NO: 276) | cmqgrespwtf (SEQ ID NO: 277) |
| V3 dir. | SLGSRA (SEQ ID NO: 278) | NNQ (SEQ ID NO: 279) | HIWDSRVPTKWV (SEQ ID NO: 280) |
| V1/V dir. "b" | TSNIGNNF (SEQ ID NO: 281) | ETD (SEQ ID NO: 282) | atwaaslssarv (SEQ ID NO: 283) |
| Anti-CD28 | QNIYVW (SEQ ID NO: 488) | KAS (SEQ ID NO: 489) | qqgqtypyt (SEQ ID NO: 490) |
| Anti-CD28 | ESVEYYVTSL (SEQ ID NO: 491) | AAS (SEQ ID NO: 492) | qqsrkvpyt (SEQ ID NO: 493) |
| Anti-CD3 | QSLVHNNANTY (SEQ ID NO: 494) | KVS (SEQ ID NO: 495) | gqgtqyp (SEQ ID NO: 496) |

TABLE B

CDR sequences of parental antibodies

| Ab | CDR_H1 | CDR_H2 | CDR_H3 | CDR_L1 | CDR_L2 | CDR_L3 |
|---|---|---|---|---|---|---|
| CD4BS "a" | DCTLN (SEQ ID NO: 248) | LKPRGGAVNYARP LQ (SEQ ID NO: 497) | GKNCDYNWDFEH (SEQ ID NO: 250) | RTSQYGSLA (SEQ ID NO: 266) | SGSTRAA (SEQ ID NO: 267) | QQYEF (SEQ ID NO: 268) |
| CD4BS "b" | GYTFTAHI (SEQ ID NO: 251) | IKPQYGAV (SEQ ID NO: 252) | DRSYGDSSWALDA (SEQ ID NO: 253) | QGVGSD (SEQ ID NO: 269) | HTS (SEQ ID NO: 270) | QVLQF (SEQ ID NO: 271) |
| MPER | GFDFDNAW (SEQ ID NO: 254) | ITGPGEGWSV (SEQ ID NO: 255) | TGKYYDFWSGYPPGE EYFQD (SEQ ID NO: 256) | SLRSHY (SEQ ID NO: 500) | GKN (SEQ ID NO: 501) | SSRDKSGSRLSV (SEQ ID NO: 274) |

TABLE B-continued

CDR sequences of parental antibodies

| Ab | CDR_H1 | CDR_H2 | CDR_H3 | CDR_L1 | CDR_L2 | CDR_L3 |
|---|---|---|---|---|---|---|
| MPER_100W | GFDFDNAW (SEQ ID NO: 254) | ITGPGEGWSV (SEQ ID NO: 255) | TGKYYDFWWGYPPGE EYFQD (SEQ ID NO: 498) | SLRSHY (SEQ ID NO: 500) | GKN (SEQ ID NO: 501) | SSRDKSGSRLSV (SEQ ID NO: 274) |
| V1/V2 directed "a" | GNTLKTYD (SEQ ID NO: 257) | ISHEGDKK (SEQ ID NO: 258) | CAKGSKHRLRDYALY DDDGALNWAVDVDYL SNLEFW (SEQ ID NO: 259) | HSLIHGDRNNY (SEQ ID NO: 275) | LAS (SEQ ID NO: 276) | CMQGRESPWTF (SEQ ID NO: 277) |
| V1/V2 directed "b" | QFRFDGYG (SEQ ID NO: 263) | ISHDGIKK (SEQ ID NO: 264) | CAKDLREDECEEWWS DYYDFGKQLPCAKSR GGLVGIADNW (SEQ ID NO: 265) | TSNIGNNF (SEQ ID NO: 281) | ETD (SEQ ID NO: 282) | ATWAASLS-SARV (SEQ ID NO: 283) |
| V3 directed | GASISDSY (SEQ ID NO: 499) | VHKSGDT (SEQ ID NO: 261) | ARTLHGRRIYGIVAF NEWFTYFYMDV (SEQ ID NO: 262) | SLGSRA (SEQ ID NO: 278) | NNQ (SEQ ID NO: 279) | HIWDSRVPTKW V (SEQ ID NO: 280) |
| CD28 | GYTFTSYY (SEQ ID NO: 479) | IYPGNVNT (SEQ ID NO: 480) | TRSHYGLDWNFDV (SEQ ID NO: 481) | QNIYVW (SEQ ID NO: 488) | KAS (SEQ ID NO: 489) | QQGQTYPYT (SEQ ID NO: 490) |
| CD28_2 | GFSLSDYG (SEQ ID NO: 482) | IWAGGGT (SEQ ID NO: 483) | ARDKGYSYYYSMD (SEQ ID NO: 484) | ESVEYYVTSL (SEQ ID NO: 491) | AAS (SEQ ID NO: 492) | QQSRKVPYT (SEQ ID NO: 493) |
| CD3 | GFTFTKAW (SEQ ID NO: 485) | IKDKSNS (SEQ ID NO: 486) | RGVYYALSPFDY (SEQ ID NO: 487) | QSLVHNNANTY (SEQ ID NO: 494) | KVS (SEQ ID NO: 495) | GQGTQYP (SEQ ID NO: 496) |

TABLE C

Variable domain sequences of parental antibodies

| Ab Name | VH | VL |
|---|---|---|
| CD4BS "a" | QVQLVQSGGQMKKPGESMRISCRASGYEFI<u>DCTLNW</u>IRLAP GKRPEWMGW<u>LKPRGGAVNYARPLQ</u>GRVTMTRDVYSDTAF LELRSLTVDDTAVYFCTR<u>GKNCDYNWDFEH</u>WGRGTPVIVS S (SEQ ID NO: 502) | EIVLTQSPGTLSLSPGETAIISC<u>RTSQYGSLAW</u>YQQ RPGQAPRLVIY<u>SGSTRAA</u>GIPDRFSGSRWGPDYNL TISNLESGDFGVYYC<u>QQYEF</u>FGQGTKVQVDIK (SEQ ID NO: 512) |
| CD4BS "b" | RAHLVQSGTAMKKPGASVRVSCQTS<u>GYTFTAHILF</u>WFRQAP GRGLEWVGW<u>IKPQYGAV</u>NFGGGFRDRVTLTRDVYREIAY MDIRGLKPDDTAVYYCARD<u>RSYGDSSWALDA</u>WGQGTTVV VSA (SEQ ID NO: 503) | YIHVTQSPSSLSVSIGDRVTINCQTS<u>QGVGSDLHW</u> YQHKPGRAPKLLI<u>HHTS</u>SVEDGVPSRFSGSGFHTS FNLTISDLQADDIATYYC<u>QVLQF</u>FGRGSRLHIK (SEQ ID NO: 513) |
| CD4BS "b" (Aglycan) | RAHLVQSGTAMKKPGASVRVSCQTS<u>GYTFTAHILF</u>WFRQAP GRGLEWVGW<u>IKPQYGAV</u>NFGGGFRDRVTLTRDVYREIAY MDIRGLKPDDTAVYYCARD<u>RSYGDSSWALDA</u>WGQGTTVV VSA (SEQ ID NO: 503) | YIHVTQSPSSLSVSIGDRVTINCQTS<u>QGVGSDLHW</u> YQHKPGRAPKLLI<u>HHTS</u>SVEDGVPSRFSGSGFHTS FQLTISDLQADDIATYYC<u>QVLQF</u>FGRGSRLHIK (SEQ ID NO: 514) |
| CD4BS "b" (Δisomerization D55E) | RAHLVQSGTAMKKPGASVRVSCQTS<u>GYTFTAHILF</u>WFRQAP GRGLEWVGW<u>IKPQYGAV</u>NFGGGFRDRVTLTRDVYREIAY MDIRGLKPDDTAVYYCARD<u>RSYGDSSWALDA</u>WGQGTTVV VSA (SEQ ID NO: 503) | YIHVTQSPSSLSVSIGDRVTINCQTS<u>QGVGSDLHW</u> YQHKPGRAPKLLI<u>HHTS</u>SVEEEGVPSRFSGSGFHTS FNLTISDLQADDIATYYC<u>QVLQF</u>FGRGSRLHIK (SEQ ID NO: 515) |
| CD4BS "b" (Δisomerization G56A) | RAHLVQSGTAMKKPGASVRVSCQTS<u>GYTFTAHILF</u>WFRQAP GRGLEWVGW<u>IKPQYGAV</u>NFGGGFRDRVTLTRDVYREIAY MDIRGLKPDDTAVYYCARD<u>RSYGDSSWALDA</u>WGQGTTVV VSA (SEQ ID NO: 503) | YIHVTQSPSSLSVSIGDRVTINCQTS<u>QGVGSDLHW</u> YQHKPGRAPKLLI<u>HHTS</u>FI<u>HHTS</u>SVEDAVPSRFSGSGFHTS FNLTISDLQADDIATYYC<u>QVLQF</u>FGRGSRLHIK (SEQ ID NO: 516) |
| CD4BS "b" (Aglycan/ Δisomerization D55E) | RAHLVQSGTAMKKPGASVRVSCQTS<u>GYTFTAHILF</u>WFRQAP GRGLEWVGW<u>IKPQYGAV</u>NFGGGFRDRVTLTRDVYREIAY MDIRGLKPDDTAVYYCARD<u>RSYGDSSWALDA</u>WGQGTTVV VSA (SEQ ID NO: 503) | YIHVTQSPSSLSVSIGDRVTINCQTS<u>QGVGSDLHW</u> YQHKPGRAPKLLI<u>HHTS</u>SVEEGVPSRFSGSGFHTS FQLTISDLQADDIATYYC<u>QVLQF</u>FGRGSRLHIK (SEQ ID NO: 517) |
| MPER | EVRLVESGGGLVKPGGSLRLSCSAS<u>GFDFDNAW</u>MTWVRQP PGKGLEWVG<u>RITGPGEGWSV</u>DYAESVKGRFTISRDNTKNTL YLEMNNVRTEDTGYYFCART<u>GKYYDFWSGYPPGEEYFQD</u> WGQGTLVIVSS (SEQ ID NO: 504) | ASELTQDPAVSVALKQTVTITCRGD<u>SLRSHYASW</u> YQKKPGQAPVLLF<u>YGKN</u>NRPSGIPDRFSGSASGN RASLTITGAQAEDEADYYC<u>SSRDKSGSRLSV</u>FGG GTKLTVL (SEQ ID NO: 518) |

TABLE C-continued

Variable domain sequences of parental antibodies

| Ab Name | VH | VL |
|---|---|---|
| MPER_100W | EVRLVESGGGLVKPGGSLRLSCSAS<u>GFDFDNAWMTWVRQP PGKGLEWVGR<u>ITGPGEGWSV</u>DYAESVKGRFTISRDNTKNTL YLEMNNVRTEDTGYYFCAR<u>TGKYYDFW*W*GYPPGEEYFQD</u> WGQGTLVIVSS (SEQ ID NO: 505) | ASELTQDPAVSVALKQTVTITCRGD<u>SLRSHYASW</u> YQKKPGQAPVLLFY<u>GKNN</u>RPSGIPDRFSGSASGN RASLTITGAQAEDEADYYC<u>SSRDKSGSRLSV</u>FGG GTKLTVL (SEQ ID NO: 518) |
| V1/V2 directed "a" | QVHLTQSGPEVRKPGTSVKVSCKAP<u>GNTLKTYDLH</u>WVRSV PGQGLQWMGW<u>ISHEGDKK</u>VIVERFKAKVTIDWDRSTNTAY LQLSGLTSGDTAVYYC<u>AKGSKHRLRDYALYDDDGALNWA VDVDYLSNLEFW</u>GQGTAVTVSS (SEQ ID NO: 506) | DFVLTQSPHSLSVTPGESASISCKSS<u>HSLIHGDRNN</u> YLAWYVQKPGRSPQLLIY<u>LASS</u>RASGVPDRFSGS GSDKDFTLKISRVETEDVGTYY<u>CMQGRESPWT</u>FG QGTKVDIK (SEQ ID NO: 519) |
| V1/V2 directed "b" | QVQLVESGGGVVQPGTSLRLSCAAS<u>QFRFDGYGN</u>IHWVRQ APGKGLEWVAS<u>ISHDGIKKY</u>HAEKVWGRFTISRDNSKNTLY LQMNSLRPEDTALYYC<u>AKDLREDECEEWWSDYYDFGKQLP CAKSRGGLVGIADNW</u>GQGTMVTVSS (SEQ ID NO: 507) | QSVLTQPPSVSAAPGQKVTISCSGN<u>TSNIGNNF</u>VS WYQQRPGRAPQLLIY<u>ETD</u>KRPSGIPDRFSASKSGT SGTLAITGLQTGDEADYYC<u>ATWAASLSSARV</u>FGT GTKVIVL (SEQ ID NO: 520) |
| V3 directed | QMQLQESGPGLVKPSETLSLTCSVS<u>GASISDSYWS</u>WIRRSP GKGLEWIGY<u>VHKSGDTNY</u>SPSLKSRVNLSLDTSKNQVSLSL VAATAADSGKYYC<u>ARTLHGRRIYGIVAFNEWFTYFYMDV</u>W GNGTQVTVSS (SEQ ID NO: 508) | SDISVAPGETARISCGEK<u>SLGSRA</u>VQWYQHRAGQ APSLIIY<u>NNQ</u>DRPSGIPERFSGSPDSPFGTTATLTIT SVEAGDEADYYC<u>HIWDSRVPTKWV</u>FGGGTTLTVL (SEQ ID NO: 521) |
| CD28 | QVQLVQSGAEVVKPGASVKVSCKAS<u>GYTFTSYYIH</u>WVRQA PGQGLEWIGS<u>IYPGNVNT</u>NYAQKFQGRATLTVDTSISTAYM ELSRLRSDDTAVYYC<u>TRSHYGLDWNFDV</u>WGKGTTVTVSS (SEQ ID NO: 509) | DIQMTQSPSSLSASVGDRVTITCQAS<u>QNIYVWLN</u> WYQQKPGKAPKLLIY<u>KASN</u>LHTGVPSRFSGSGSG TDFTLTISSLQPEDIATYYC<u>QQGQTYPYT</u>FGQGTK LEIK (SEQ ID NO: 522) |
| CD28_2 | QVQLQESGPGLVKPSQTLSLTCTVS<u>GFSLSDYG</u>VHWVRQPP GKGLEWLGV<u>IWAGGGTNY</u>NPSLKSRKTISKDTSKNQVSLKL SSVTAADTAVYYC<u>ARDKGYSYYYSMD</u>YWGQGTTVTVSS (SEQ ID NO: 510) | DIVLTQSPASLAVSPGQRATITCRASE<u>SVEYYVTS</u> LMQWYQQKPGQPPKLLIF<u>AASN</u>VESGVPARFSGS GSGTDFTLTINPVEANDVANYYC<u>QQSRKVPYT</u>FG QGTKLEIK (SEQ ID NO: 523) |
| CD3 | QVQLVESGGGVVQPGRSLRLSCAAS<u>GFTFTKAWMH</u>WVRQ APGKQLEWVAQ<u>IKDKSNS</u>YATYYADSVKGRFTISRDDSKNT LYLQMNSLRAEDTAVYYC<u>RGVYYALSPFDY</u>WGQGTLVTV SS (SEQ ID NO: 511) | DIVMTQTPLSLSVTPGQPASISCKSS<u>QSLVHNNAN</u> <u>TYL</u>SWYLQKPGQSPQSLIY<u>KVS</u>NRFSGVPDRFSGS GSGTDFTLKISRVEAEDVGVYYC<u>GQGTQYPFT</u>FG SGTKVEIK (SEQ ID NO: 524) |

CDR sequences are underlined.
Variable domain modifications are shown in bold and italicized.

SEQUENCE LISTING (526 sequences)

SEQ ID NO: 1 - protein, 450 aa, Artificial Sequence
  Synthetic Construct
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVLHEALHSHYTQKSLSLSPG

SEQ ID NO: 2 - protein, 210 aa, Artificial Sequence
  Synthetic Construct
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3 - protein, 611 aa, Artificial Sequence
  Synthetic Construct
EVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSDKTHTQVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 4 - protein, 338 aa, Artificial Sequence [sequence omitted]

SEQ ID NO: 5 - DNA, 1350 bp, Artificial Sequence
  Synthetic Construct
caggtgcagctggtgcagtctggcggccagatgaagaaacccggcgagagcatgcggatcagctgcagagccagcggctacgagttcatcgactgcaccctgaactggatcagactggcccctggcaagcggcctgagtggatgggatggctgaagcctagaggcggagccgtgaactacgccagacctctgcagggcagagtgaccatgacccgggacgtgtacagcgataccgccttcctggaactgcggagcctgaccgtggatgataccgccgtgtacttctgcacccggggcaagaactgcgactacaactgggacttcgagcactggggcagaggcacccctgtgatcgtgtcaagcgcgtcgaccaagggccccagcgtgttccctctggcccctagcagcaagagcacatctggcggaacagccgccctgggctgcctcgtgaaggactactttcccgagcccgtgaccgtgtcctggaattctggcgccctgaccagcggcgtgcacacctttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgaaccccaggtgtgcacactgcccccaagcagggacgagctgaccaagaaccaggtgtccctgagctgtgccgtgaaaggcttctacccctccgatatcgccgtggaatgggagagcaacggccagcccgagaacaactacaagaccaccccccctgtgctggacagcgacggctcattcttcctggtgtccaagctgacagtggacaagtcccggtggcagcagggcaacgtgttcagctgctccgtgctgcacgaggccctgcacagccactacacccagaagtccctgagcctgagccccggc

SEQ ID NO: 6 - DNA, 630 bp, Artificial Sequence
  Synthetic Construct
gagatcgtgctgacacagagccctggcaccctgagcctgtctccaggcgagacagccatcatcagctgccggacaagccagtacggcagcctggcctggtatcagcagaggcctggacaggcccccagactcgtgatctacagcggcagcacaagagccgccggaatccccgatagattcagcggctccagatggggccctgactacaacctgaccatcagcaacctggaaagcggcgacttcggcgtgtactactgccagcagtacgagttcttcggccagggcaccaaggtgcaggtggacatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 7 - DNA, 1833 bp, Artificial Sequence
  Synthetic Construct
gaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtccggctatccccctggcgaggaatattttcaagactggggtcagggaacccttgttatcgtgtcctccgacaaaacccatacccaggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgctgcatgaggctctgcacagccactacacgcagaagagcctctccctgtctccgggt

SEQ ID NO: 8 - DNA, 1014 bp, Artificial Sequence
  Synthetic Construct
gacttcgtgctgacccagagccctcacagcctgagcgtgacacctggcgagagcgccagcatcagctgcaagagcagccactccctgatccacggcgaccggaacaactacctggcttggtacgtgcagaagcccggcagatccccccagctgctgatctacctggccagcagcagagccagcggcgtgcccgatagattttctggcagcggcagcgacaaggacttcaccctgaagatcagccgggtggaaaccgaggacgtgggcacctactactgtatgcagggcagagagagcccctggacctttggccagggcaccaaggtggacatcaaggacaaaacccataccgcatccgaactgactcaggaccctgccgtctctgtggcactgaagcagactgtgactattacttgccgaggcgactcactgcggagccactacgcttcctggtatcagaagaaacccggccaggcacctgtgctgctgttctacggaaagaacaataggccatctggcatccccgaccgcttttctggcagtgcatcagggaaccgagccagtctgaccattaccggcgcccaggctgaggacgaagccgattactattgcagctcccgggataagagcggctccagactgagcgtgttcggaggaggaactaaactgaccgtcctcgataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 9 - protein, 451 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVLHEALHSHYTQKSLSLSPG

SEQ ID NO: 10 - protein, 210 aa, Artificial Sequence
  Synthetic Construct
YIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11 - protein, 611 aa, Artificial Sequence; identical to SEQ ID NO: 3
  Synthetic Construct

SEQ ID NO: 12 - protein, 338 aa, Artificial Sequence [sequence omitted]

SEQ ID NO: 13 - DNA, 1353 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgcctctacaaagggccccagcgtgttccctctggcccctagcagcaagagcacatctggcggaacagccgccctgggctgcctcgtgaaggactactttcccgagcccgtgaccgtgtcctggaattctggcgccctgaccagcggcgtgcacacctttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgaaccccaggtgtgcacactgcccccaagcagggacgagctgaccaagaaccaggtgtccctgagctgtgccgtgaaaggcttctacccctccgatatcgccgtggaatgggagagcaacggccagcccgagaacaactacaagaccaccccccctgtgctggacagcgacggctcattcttcctggtgtccaagctgacagtggacaagtcccggtggcagcagggcaacgtgttcagctgctccgtgctgcacgaggccctgcacagccactacacccagaagtccctgagcctgagccccggc

SEQ ID NO: 14 - DNA, 630 bp, Artificial Sequence
  Synthetic Construct
tacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatggcgtgcccagcagattttccggcagcggcttccacaccagcttcaacctgaccatcagcgatctgcaggccgacgacattgccacctactattgtcaggtgctgcagttcttcggcagaggcagcagactgcacatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 15 - DNA, 1833 bp, Artificial Sequence; identical to SEQ ID NO: 7
  Synthetic Construct

SEQ ID NO: 16 - DNA, 1014 bp, Artificial Sequence; identical to SEQ ID NO: 8
  Synthetic Construct

SEQ ID NO: 17 - protein, 451 aa, Artificial Sequence; identical to SEQ ID NO: 9
  Synthetic Construct

SEQ ID NO: 18 - protein, 210 aa, Artificial Sequence; identical to SEQ ID NO: 10
  Synthetic Construct

SEQ ID NO: 19 - protein, 611 aa, Artificial Sequence
  Synthetic Construct
QVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSDKTHTEVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 20 - protein, 338 aa, Artificial Sequence
  Synthetic Construct
ASELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLDKTHTDFVLTQSPHSLSVTPGESASISCKSSHSLIHGDRNNYLAWYVQKPGRSPQLLIYLASSRASGVPDRFSGSGSDKDFTLKISRVETEDVGTYYCMQGRESPWTFGQGTKVDIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 21 - DNA, 1353 bp, Artificial Sequence; identical to SEQ ID NO: 13
  Synthetic Construct

SEQ ID NO: 22 - DNA, 630 bp, Artificial Sequence; identical to SEQ ID NO: 14
  Synthetic Construct

SEQ ID NO: 23 - DNA, 1833 bp, Artificial Sequence
  Synthetic Construct
caggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctgacaaaacccataccgaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtccggctatccccctggcgaggaatattttcaagactggggtcagggaacccttgttatcgtgtcctccgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgctgcatgaggctctgcacagccactacacgcagaagagcctctccctgtctccgggt

SEQ ID NO: 24 - DNA, 1014 bp, Artificial Sequence
  Synthetic Construct
gcatccgaactgactcaggaccctgccgtctctgtggcactgaagcagactgtgactattacttgccgaggcgactcactgcggagccactacgcttcctggtatcagaagaaacccggccaggcacctgtgctgctgttctacggaaagaacaataggccatctggcatccccgaccgcttttctggcagtgcatcagggaaccgagccagtctgaccattaccggcgcccaggctgaggacgaagccgattactattgcagctcccgggataagagcggctccagactgagcgtgttcggaggaggaactaaactgaccgtcctcgacaaaacccataccgacttcgtgctgacccagagccctcacagcctgagcgtgacacctggcgagagcgccagcatcagctgcaagagcagccactccctgatccacggcgaccggaacaactacctggcttggtacgtgcagaagcccggcagatccccccagctgctgatctacctggccagcagcagagccagcggcgtgcccgatagattttctggcagcggcagcgacaaggacttcaccctgaagatcagccgggtggaaaccgaggacgtgggcacctactactgtatgcagggcagagagagcccctggacctttggccagggcaccaaggtggacatcaaggataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 25 - protein, 450 aa, Artificial Sequence
  Synthetic Construct
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 26 - protein, 210 aa, Artificial Sequence; identical to SEQ ID NO: 2
  Synthetic Construct

SEQ ID NO: 27 - protein, 611 aa, Artificial Sequence
  Synthetic Construct
EVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWWGYPPGEEYFQDWGQGTLVIVSSDKTHTQVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 28 - protein, 338 aa, Artificial Sequence [sequence omitted]

SEQ ID NO: 29 - DNA, 1350 bp, Artificial Sequence
  Synthetic Construct
caggtgcagctggtgcagtctggcggccagatgaagaaacccggcgagagcatgcggatcagctgcagagccagcggctacgagttcatcgactgcaccctgaactggatcagactggcccctggcaagcggcctgagtggatgggatggctgaagcctagaggcggagccgtgaactacgccagacctctgcagggcagagtgaccatgacccgggacgtgtacagcgataccgccttcctggaactgcggagcctgaccgtggatgataccgccgtgtacttctgcacccggggcaagaactgcgactacaactgggacttcgagcactggggcagaggcacccctgtgatcgtgtcaagcgcgtcgaccaagggccccagcgtgttccctctggcccctagcagcaagagcacatctggcggaacagccgccctgggctgcctcgtgaaggactactttcccgagcccgtgaccgtgtcctggaattctggcgccctgaccagcggcgtgcacacctttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgaaccccaggtgtgcacactgcccccaagcagggacgagctgaccaagaaccaggtgtccctgagctgtgccgtgaaaggcttctacccctccgatatcgccgtggaatgggagagcaacggccagcccgagaacaactacaagaccaccccccctgtgctggacagcgacggctcattcttcctggtgtccaagctgacagtggacaagtcccggtggcagcagggcaacgtgttcagctgctccgtgatgcacgaggccctgcacaaccactacacccagaagtccctgagcctgagccccggc

SEQ ID NO: 30 - DNA, 630 bp, Artificial Sequence; identical to SEQ ID NO: 6
  Synthetic Construct

SEQ ID NO: 31 - DNA, 1833 bp, Artificial Sequence
  Synthetic Construct
gaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtggggctatccccctggcgaggaatattttcaagactggggtcagggaacccttgttatcgtgtcctccgacaaaacccatacccaggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgctgcatgaggctctgcacagccactacacgcagaagagcctctccctgtctccgggt

SEQ ID NO: 32 - DNA, 1014 bp, Artificial Sequence; identical to SEQ ID NO: 8
  Synthetic Construct

SEQ ID NO: 33 - protein, 450 aa, Artificial Sequence; identical to SEQ ID NO: 25
  Synthetic Construct

SEQ ID NO: 34 - protein, 210 aa, Artificial Sequence; identical to SEQ ID NO: 2
  Synthetic Construct

SEQ ID NO: 35 - protein, 602 aa, Artificial Sequence
  Synthetic Construct
EVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWWGYPPGEEYFQDWGQGTLVIVSSDKTHTQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 36 - protein, 331 aa, Artificial Sequence
  Synthetic Construct
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLDKTHTASELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 37 - DNA, 1350 bp, Artificial Sequence; identical to SEQ ID NO: 29
  Synthetic Construct

SEQ ID NO: 38 - DNA, 630 bp, Artificial Sequence; identical to SEQ ID NO: 6
  Synthetic Construct

SEQ ID NO: 39 - DNA, 1806 bp, Artificial Sequence
  Synthetic Construct
gaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtggggctatccccctggcgaggaatattttcaagactggggtcagggaacccttgttatcgtgtcctccgacaaaacccatacccagatgcagctgcaggagagcggccctggactcgtgaagcccagcgagaccctgagcctgacatgcagcgtgagcggcgccagcatcagcgacagctactggagctggatcaggaggagccctggcaagggcctggagtggatcggctacgtgcacaagagcggcgacaccaactacagcccctccctgaagtccagggtgaacctgtccctggacaccagcaagaaccaggtgagcctgtccctggtggctgccacagctgctgacagcggcaagtactactgtgccaggaccctgcacggcaggaggatctacggcatcgtggccttcaacgagtggttcacctacttctacatggacgtgtggggcaacggcacccaggtgaccgtgagctccgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 40 - DNA, 993 bp, Artificial Sequence
  Synthetic Construct
tccgacatcagcgtggcccccggagagacagccaggatctcctgcggcgagaagagcctgggaagcagggctgtgcagtggtaccaacacagggccggacaggctcccagcctgatcatctacaacaaccaggacaggcccagcggcatccctgagaggttcagcggaagccccgacagccccttcggaaccacagccaccctgaccatcacaagcgtggaagccggcgacgaggccgactactactgccacatctgggacagcagggtgcccaccaagtgggtgtttggcggcggcaccaccctgaccgtgctggacaaaacccataccgcatccgaactgactcaggaccctgccgtctctgtggcactgaagcagactgtgactattacttgccgaggcgactcactgcggagccactacgcttcctggtatcagaagaaacccggccaggcacctgtgctgctgttctacggaaagaacaataggccatctggcatccccgaccgcttttctggcagtgcatcagggaaccgagccagtctgaccattaccggcgcccaggctgaggacgaagccgattactattgcagctcccgggataagagcggctccagactgagcgtgttcggaggaggaactaaactgaccgtcctcgataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 41 - protein, 450 aa, Artificial Sequence; identical to SEQ ID NO: 25
  Synthetic Construct

SEQ ID NO: 42 - protein, 210 aa, Artificial Sequence; identical to SEQ ID NO: 2
  Synthetic Construct

SEQ ID NO: 43 - protein, 611 aa, Artificial Sequence
  Synthetic Construct
QVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSDKTHTEVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWWGYPPGEEYFQDWGQGTLVIVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 44 - protein, 338 aa, Artificial Sequence; identical to SEQ ID NO: 20
  Synthetic Construct

SEQ ID NO: 45 - DNA, 1350 bp, Artificial Sequence; identical to SEQ ID NO: 29
  Synthetic Construct

SEQ ID NO: 46 - DNA, 630 bp, Artificial Sequence; identical to SEQ ID NO: 6
  Synthetic Construct

SEQ ID NO: 47 - DNA, 1833 bp, Artificial Sequence
  Synthetic Construct
caggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctgacaaaacccataccgaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtggggctatccccctggcgaggaatattttcaagactggggtcagggaacccttgttatcgtgtcctccgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 48 - DNA, 1014 bp, Artificial Sequence; identical to SEQ ID NO: 24
  Synthetic Construct

SEQ ID NO: 49 - protein, 450 aa, Artificial Sequence; identical to SEQ ID NO: 25
  Synthetic Construct

SEQ ID NO: 50 - protein, 210 aa, Artificial Sequence; identical to SEQ ID NO: 2
  Synthetic Construct

SEQ ID NO: 51 - protein, 612 aa, Artificial Sequence
  Synthetic Construct
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSDKTHTQVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 52 - protein, 334 aa, Artificial Sequence
  Synthetic Construct
DFVLTQSPHSLSVTPGESASISCKSSHSLIHGDRNNYLAWYVQKPGRSPQLLIYLASSRASGVPDRFSGSGSDKDFTLKISRVETEDVGTYYCMQGRESPWTFGQGTKVDIKDKTHTSDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 53 - DNA, 1350 bp, Artificial Sequence; identical to SEQ ID NO: 29
  Synthetic Construct

SEQ ID NO: 54 - DNA, 630 bp, Artificial Sequence; identical to SEQ ID NO: 6
  Synthetic Construct

SEQ ID NO: 55 - DNA, 1836 bp, Artificial Sequence
  Synthetic Construct
cagatgcagctgcaggagagcggccctggactcgtgaagcccagcgagaccctgagcctgacatgcagcgtgagcggcgccagcatcagcgacagctactggagctggatcaggaggagccctggcaagggcctggagtggatcggctacgtgcacaagagcggcgacaccaactacagcccctccctgaagtccagggtgaacctgtccctggacaccagcaagaaccaggtgagcctgtccctggtggctgccacagctgctgacagcggcaagtactactgtgccaggaccctgcacggcaggaggatctacggcatcgtggccttcaacgagtggttcacctacttctacatggacgtgtggggcaacggcacccaggtgaccgtgagctccgacaaaacccatacccaggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 56 - DNA, 1002 bp, Artificial Sequence
  Synthetic Construct
gacttcgtgctgacccagagccctcacagcctgagcgtgacacctggcgagagcgccagcatcagctgcaagagcagccactccctgatccacggcgaccggaacaactacctggcttggtacgtgcagaagcccggcagatccccccagctgctgatctacctggccagcagcagagccagcggcgtgcccgatagattttctggcagcggcagcgacaaggacttcaccctgaagatcagccgggtggaaaccgaggacgtgggcacctactactgtatgcagggcagagagagcccctggacctttggccagggcaccaaggtggacatcaaggacaaaacccatacctccgacatcagcgtggcccccggagagacagccaggatctcctgcggcgagaagagcctgggaagcagggctgtgcagtggtaccaacacagggccggacaggctcccagcctgatcatctacaacaaccaggacaggcccagcggcatccctgagaggttcagcggaagccccgacagccccttcggaaccacagccaccctgaccatcacaagcgtggaagccggcgacgaggccgactactactgccacatctgggacagcagggtgcccaccaagtgggtgtttggcggcggcaccaccctgaccgtgctggataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 57 - protein, 451 aa, Artificial Sequence; identical to SEQ ID NO: 9
  Synthetic Construct

SEQ ID NO: 58 - protein, 210 aa, Artificial Sequence; identical to SEQ ID NO: 10
  Synthetic Construct

SEQ ID NO: 59 - protein, 615 aa, Artificial Sequence
  Synthetic Construct
EVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWWGYPPGEEYFQDWGQGTLVIVSSDKTHTQVQLVESGGGVVQPGTSLRLSCAASQFRFDGYGMHWVRQAPGKGLEWVASISHDGIKKYHAEKVWGRFTISRDNSKNTLYLQMNSLRPEDTALYYCAKDLREDECEEWWSDYYDFGKQLPCAKSRGGLVGIADNWGQGTMVTVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 60 - protein, 337 aa, Artificial Sequence
  Synthetic Construct
QSVLTQPPSVSAAPGQKVTISCSGNTSNIGNNFVSWYQQRPGRAPQLLIYETDKRPSGIPDRFSASKSGTSGTLAITGLQTGDEADYYCATWAASLSSARVFGTGTKVIVLDKTHTASELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61 - DNA, 1356 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgcctctacaaagggccccagcgtgttccctctggcccctagcagcaagagcacatctggcggaacagccgccctgggctgcctcgtgaaggactactttcccgagcccgtgaccgtgtcctggaattctggcgccctgaccagcggcgtgcacacctttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgaaccccaggtgtgcacactgcccccaagcagggacgagctgaccaagaaccaggtgtccctgagctgtgccgtgaaaggcttctacccctccgatatcgccgtggaatgggagagcaacggccagcccgagaacaactacaagaccaccccccctgtgctggacagcgacggctcattcttcctggtgtccaagctgacagtggacaagtcccggtggcagcagggcaacgtgttcagctgctccgtgatgcacgaggccctgcacaaccactacacccagaagtccctgagcctgagccccggcaag

SEQ ID NO: 62 - DNA, 630 bp, Artificial Sequence; identical to SEQ ID NO: 14
  Synthetic Construct

SEQ ID NO: 63 - DNA, 1845 bp, Artificial Sequence
  Synthetic Construct
gaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtggggctatccccctggcgaggaatattttcaagactggggtcagggaacccttgttatcgtgtcctccgacaaaacccatacccaggtgcagttggtggagtctgggggaggcgtggtccagcctgggacgtccctgagactctcctgtgcagcctctcaattcaggtttgatggttatggcatgcactgggtccgccaggccccaggcaaggggctggagtgggtggcatctatatcacatgatggaattaaaaagtatcacgcagaaaaagtgtggggccgcttcaccatctccagagacaattccaagaacacactgtatctacaaatgaacagcctgcgacctgaggacacggctctctactactgtgcgaaagatttgcgagaagacgaatgtgaagagtggtggtcggattattacgattttgggaaacaactcccttgcgcaaagtcacgcggcggcttggttggaattgctgataactggggccaagggacaatggtcaccgtctcttcagataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 64 - DNA, 1011 bp, Artificial Sequence
  Synthetic Construct
cagtctgtgctgacgcagccgccctcagtgtctgcggccccaggacagaaggtcaccatctcctgctctggaaacacctccaacattggcaataattttgtgtcctggtatcaacagcgccccggcagagccccccaactcctcatttatgaaactgacaagcgaccctcagggattcctgaccgattctctgcttccaagtctggtacgtcaggcaccctggccatcaccgggctgcagactggggacgaggccgattattactgcgccacatgggctgccagcctgagttccgcgcgtgtcttcggaactgggaccaaggtcatcgtcctggacaaaacccataccgcatccgaactgactcaggaccctgccgtctctgtggcactgaagcagactgtgactattacttgccgaggcgactcactgcggagccactacgcttcctggtatcagaagaaacccggccaggcacctgtgctgctgttctacggaaagaacaataggccatctggcatccccgaccgcttttctggcagtgcatcagggaaccgagccagtctgaccattaccggcgcccaggctgaggacgaagccgattactattgcagctcccgggataagagcggctccagactgagcgtgttcggaggaggaactaaactgaccgtcctcgataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 65 - protein, 450 aa, Artificial Sequence; identical to SEQ ID NO: 25
  Synthetic Construct

SEQ ID NO: 66 - protein, 210 aa, Artificial Sequence; identical to SEQ ID NO: 2
  Synthetic Construct

SEQ ID NO: 67 - protein, 615 aa, Artificial Sequence; identical to SEQ ID NO: 59
  Synthetic Construct

SEQ ID NO: 68 - protein, 337 aa, Artificial Sequence; identical to SEQ ID NO: 60
  Synthetic Construct

SEQ ID NO: 69 - DNA, 1350 bp, Artificial Sequence; identical to SEQ ID NO: 29
  Synthetic Construct

SEQ ID NO: 70 - DNA, 630 bp, Artificial Sequence; identical to SEQ ID NO: 6
  Synthetic Construct

SEQ ID NO: 71 - DNA, 1845 bp, Artificial Sequence; identical to SEQ ID NO: 63
  Synthetic Construct

SEQ ID NO: 72 - DNA, 1011 bp, Artificial Sequence; identical to SEQ ID NO: 64
  Synthetic Construct

SEQ ID NO: 73 - protein, 450 aa, Artificial Sequence; identical to SEQ ID NO: 25
  Synthetic Construct

SEQ ID NO: 74 - protein, 210 aa, Artificial Sequence; identical to SEQ ID NO: 2
  Synthetic Construct

SEQ ID NO: 75 - protein, 615 aa, Artificial Sequence
  Synthetic Construct
QVQLVESGGGVVQPGTSLRLSCAASQFRFDGYGMHWVRQAPGKGLEWVASISHDGIKKYHAEKVWGRFTISRDNSKNTLYLQMNSLRPEDTALYYCAKDLREDECEEWWSDYYDFGKQLPCAKSRGGLVGIADNWGQGTMVTVSSDKTHTEVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWWGYPPGEEYFQDWGQGTLVIVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 76 - protein, 337 aa, Artificial Sequence
  Synthetic Construct
ASELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLDKTHTQSVLTQPPSVSAAPGQKVTISCSGNTSNIGNNFVSWYQQRPGRAPQLLIYETDKRPSGIPDRFSASKSGTSGTLAITGLQTGDEADYYCATWAASLSSARVFGTGTKVIVLDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 77 - DNA, 1350 bp, Artificial Sequence; identical to SEQ ID NO: 29
  Synthetic Construct

SEQ ID NO: 78 - DNA, 630 bp, Artificial Sequence; identical to SEQ ID NO: 6
  Synthetic Construct

SEQ ID NO: 79 - DNA, 1845 bp, Artificial Sequence
  Synthetic Construct
caggtgcagttggtggagtctgggggaggcgtggtccagcctgggacgtccctgagactctcctgtgcagcctctcaattcaggtttgatggttatggcatgcactgggtccgccaggccccaggcaaggggctggagtgggtggcatctatatcacatgatggaattaaaaagtatcacgcagaaaaagtgtggggccgcttcaccatctccagagacaattccaagaacacactgtatctacaaatgaacagcctgcgacctgaggacacggctctctactactgtgcgaaagatttgcgagaagacgaatgtgaagagtggtggtcggattattacgattttgggaaacaactcccttgcgcaaagtcacgcggcggcttggttggaattgctgataactggggccaagggacaatggtcaccgtctcttcagacaaaacccataccgaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtccggctatccccctggcgaggaatattttcaagactggggtcagggaacccttgttatcgtgtcctccgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 80 - DNA, 1011 bp, Artificial Sequence
  Synthetic Construct
gcatccgaactgactcaggaccctgccgtctctgtggcactgaagcagactgtgactattacttgccgaggcgactcactgcggagccactacgcttcctggtatcagaagaaacccggccaggcacctgtgctgctgttctacggaaagaacaataggccatctggcatccccgaccgcttttctggcagtgcatcagggaaccgagccagtctgaccattaccggcgcccaggctgaggacgaagccgattactattgcagctcccgggataagagcggctccagactgagcgtgttcggaggaggaactaaactgaccgtcctcgacaaaacccatacccagtctgtgctgacgcagccgccctcagtgtctgcggccccaggacagaaggtcaccatctcctgctctggaaacacctccaacattggcaataattttgtgtcctggtatcaacagcgccccggcagagccccccaactcctcatttatgaaactgacaagcgaccctcagggattcctgaccgattctctgcttccaagtctggtacgtcaggcaccctggccatcaccgggctgcagactggggacgaggccgattattactgcgccacatgggctgccagcctgagttccgcgcgtgtcttcggaactgggaccaaggtcatcgtcctggataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 81 - protein, 451 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 82 - protein, 210 aa, Artificial Sequence; identical to SEQ ID NO: 10
  Synthetic Construct

SEQ ID NO: 83 - protein, 611 aa, Artificial Sequence; identical to SEQ ID NO: 27
  Synthetic Construct

SEQ ID NO: 84 - protein, 338 aa, Artificial Sequence [sequence omitted]

SEQ ID NO: 85 - DNA, 1356 bp, Artificial Sequence; identical to SEQ ID NO: 61
  Synthetic Construct

SEQ ID NO: 86 - DNA, 630 bp, Artificial Sequence; identical to SEQ ID NO: 14
  Synthetic Construct

SEQ ID NO: 87 - DNA, 1833 bp, Artificial Sequence
  Synthetic Construct
gaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtggggctatccccctggcgaggaatattttcaagactggggtcagggaacccttgttatcgtgtcctccgacaaaacccatacccaggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 88 - DNA, 1014 bp, Artificial Sequence; identical to SEQ ID NO: 8
  Synthetic Construct

SEQ ID NO: 89 - protein, 451 aa, Artificial Sequence; identical to SEQ ID NO: 81
  Synthetic Construct

SEQ ID NO: 90 - protein, 210 aa, Artificial Sequence; identical to SEQ ID NO: 10
  Synthetic Construct

SEQ ID NO: 91 - protein, 602 aa, Artificial Sequence; identical to SEQ ID NO: 35
  Synthetic Construct

SEQ ID NO: 92 - protein, 331 aa, Artificial Sequence; identical to SEQ ID NO: 36
  Synthetic Construct

SEQ ID NO: 93 - DNA, 1356 bp, Artificial Sequence; identical to SEQ ID NO: 61
  Synthetic Construct

SEQ ID NO: 94 - DNA, 630 bp, Artificial Sequence; identical to SEQ ID NO: 14
  Synthetic Construct

SEQ ID NO: 95 - DNA, 1806 bp, Artificial Sequence; identical to SEQ ID NO: 39
  Synthetic Construct

SEQ ID NO: 96 - DNA, 993 bp, Artificial Sequence; identical to SEQ ID NO: 40
  Synthetic Construct

SEQ ID NO: 97 - protein, 470 aa, Artificial Sequence
  Synthetic Construct
QVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 98 - protein, 219 aa, Artificial Sequence
  Synthetic Construct
DFVLTQSPHSLSVTPGESASISCKSSHSLIHGDRNNYLAWYVQKPGRSPQLLIYLASSRASGVPDRFSGSGSDKDFTLKISRVETEDVGTYYCMQGRESPWTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 99 - protein, 602 aa, Artificial Sequence; identical to SEQ ID NO: 35
  Synthetic Construct

SEQ ID NO: 100 - protein, 331 aa, Artificial Sequence; identical to SEQ ID NO: 36
  Synthetic Construct

SEQ ID NO: 101 - DNA, 1413 bp, Artificial Sequence
  Synthetic Construct
caggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctgcttcgaccaagggccccagcgtgttccctctggcccctagcagcaagagcacatctggcggaacagccgccctgggctgcctcgtgaaggactactttcccgagcccgtgaccgtgtcctggaattctggcgccctgaccagcggcgtgcacacctttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgaaccccaggtgtgcacactgcccccaagcagggacgagctgaccaagaaccaggtgtccctgagctgtgccgtgaaaggcttctacccctccgatatcgccgtggaatgggagagcaacggccagcccgagaacaactacaagaccaccccccctgtgctggacagcgacggctcattcttcctggtgtccaagctgacagtggacaagtcccggtggcagcagggcaacgtgttcagctgctccgtgatgcacgaggccctgcacaaccactacacccagaagtccctgagcctgagccccggcaag

SEQ ID NO: 102 - DNA, 657 bp, Artificial Sequence
  Synthetic Construct
gacttcgtgctgacccagagccctcacagcctgagcgtgacacctggcgagagcgccagcatcagctgcaagagcagccactccctgatccacggcgaccggaacaactacctggcttggtacgtgcagaagcccggcagatccccccagctgctgatctacctggccagcagcagagccagcggcgtgcccgatagattttctggcagcggcagcgacaaggacttcaccctgaagatcagccgggtggaaaccgaggacgtgggcacctactactgtatgcagggcagagagagcccctggacctttggccagggcaccaaggtggacatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 103 - DNA, 1806 bp, Artificial Sequence; identical to SEQ ID NO: 39
  Synthetic Construct

SEQ ID NO: 104 - DNA, 993 bp, Artificial Sequence; identical to SEQ ID NO: 40
  Synthetic Construct

SEQ ID NO: 105 - protein, 451 aa, Artificial Sequence; identical to SEQ ID NO: 81
  Synthetic Construct

SEQ ID NO: 106 - protein, 210 aa, Artificial Sequence; identical to SEQ ID NO: 10
  Synthetic Construct

SEQ ID NO: 107 - protein, 611 aa, Artificial Sequence; identical to SEQ ID NO: 43
  Synthetic Construct

SEQ ID NO: 108 - protein, 338 aa, Artificial Sequence; identical to SEQ ID NO: 20
  Synthetic Construct

SEQ ID NO: 109 - DNA, 1356 bp, Artificial Sequence; identical to SEQ ID NO: 61
  Synthetic Construct

SEQ ID NO: 110 - DNA, 630 bp, Artificial Sequence; identical to SEQ ID NO: 14
  Synthetic Construct

SEQ ID NO: 111 - DNA, 1833 bp, Artificial Sequence; identical to SEQ ID NO: 47
  Synthetic Construct

SEQ ID NO: 112 - DNA, 1014 bp, Artificial Sequence; identical to SEQ ID NO: 24
  Synthetic Construct

SEQ ID NO: 113 - protein, 470 aa, Artificial Sequence; identical to SEQ ID NO: 97
  Synthetic Construct

SEQ ID NO: 114 - protein, 219 aa, Artificial Sequence; identical to SEQ ID NO: 98
  Synthetic Construct

SEQ ID NO: 115 - protein, 602 aa, Artificial Sequence
  Synthetic Construct
EVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSDKTHTQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 116 - protein, 331 aa, Artificial Sequence; identical to SEQ ID NO: 36
  Synthetic Construct

SEQ ID NO: 117 - DNA, 1413 bp, Artificial Sequence; identical to SEQ ID NO: 101
  Synthetic Construct

SEQ ID NO: 118 - DNA, 657 bp, Artificial Sequence; identical to SEQ ID NO: 102
  Synthetic Construct

SEQ ID NO: 119 - DNA, 1806 bp, Artificial Sequence
  Synthetic Construct
gaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtccggctatccccctggcgaggaatattttcaagactggggtcagggaacccttgttatcgtgtcctccgacaaaacccatacccagatgcagctgcaggagagcggccctggactcgtgaagcccagcgagaccctgagcctgacatgcagcgtgagcggcgccagcatcagcgacagctactggagctggatcaggaggagccctggcaagggcctggagtggatcggctacgtgcacaagagcggcgacaccaactacagcccctccctgaagtccagggtgaacctgtccctggacaccagcaagaaccaggtgagcctgtccctggtggctgccacagctgctgacagcggcaagtactactgtgccaggaccctgcacggcaggaggatctacggcatcgtggccttcaacgagtggttcacctacttctacatggacgtgtggggcaacggcacccaggtgaccgtgagctccgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 120 - DNA, 993 bp, Artificial Sequence; identical to SEQ ID NO: 40
  Synthetic Construct

SEQ ID NO: 121 - protein, 451 aa, Artificial Sequence; identical to SEQ ID NO: 81
  Synthetic Construct

SEQ ID NO: 122 - protein, 210 aa, Artificial Sequence; identical to SEQ ID NO: 10
  Synthetic Construct

SEQ ID NO: 123 - protein, 602 aa, Artificial Sequence; identical to SEQ ID NO: 115
  Synthetic Construct

SEQ ID NO: 124 - protein, 331 aa, Artificial Sequence; identical to SEQ ID NO: 36
  Synthetic Construct

SEQ ID NO: 125 - DNA, 1356 bp, Artificial Sequence; identical to SEQ ID NO: 61
  Synthetic Construct

SEQ ID NO: 126 - DNA, 630 bp, Artificial Sequence; identical to SEQ ID NO: 14
  Synthetic Construct

SEQ ID NO: 127 - DNA, 1806 bp, Artificial Sequence; identical to SEQ ID NO: 119
  Synthetic Construct

SEQ ID NO: 128 - DNA, 993 bp, Artificial Sequence; identical to SEQ ID NO: 40
  Synthetic Construct

SEQ ID NO: 129 - protein, 451 aa, Artificial Sequence; identical to SEQ ID NO: 81
  Synthetic Construct

SEQ ID NO: 130 - protein, 210 aa, Artificial Sequence; identical to SEQ ID NO: 10
  Synthetic Construct

SEQ ID NO: 131 - protein, 612 aa, Artificial Sequence
  Synthetic Construct
QVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSDKTHTQMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 132 - protein, 334 aa, Artificial Sequence
  Synthetic Construct
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLDKTHTDFVLTQSPHSLSVTPGESASISCKSSHSLIHGDRNNYLAWYVQKPGRSPQLLIYLASSRASGVPDRFSGSGSDKDFTLKISRVETEDVGTYYCMQGRESPWTFGQGTKVDIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - DNA, 1356 bp, Artificial Sequence; identical to SEQ ID NO: 61
  Synthetic Construct

SEQ ID NO: 134 - DNA, 630 bp, Artificial Sequence; identical to SEQ ID NO: 14
  Synthetic Construct

SEQ ID NO: 135 - DNA, 1836 bp, Artificial Sequence
  Synthetic Construct
caggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctgacaaaacccatacccagatgcagctgcaggagagcggccctggactcgtgaagcccagcgagaccctgagcctgacatgcagcgtgagcggcgccagcatcagcgacagctactggagctggatcaggaggagccctggcaagggcctggagtggatcggctacgtgcacaagagcggcgacaccaactacagcccctccctgaagtccagggtgaacctgtccctggacaccagcaagaaccaggtgagcctgtccctggtggctgccacagctgctgacagcggcaagtactactgtgccaggaccctgcacggcaggaggatctacggcatcgtggccttcaacgagtggttcacctacttctacatggacgtgtggggcaacggcacccaggtgaccgtgagctccgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 136 - DNA, 1002 bp, Artificial Sequence
  Synthetic Construct
tccgacatcagcgtggcccccggagagacagccaggatctcctgcggcgagaagagcctgggaagcagggctgtgcagtggtaccaacacagggccggacaggctcccagcctgatcatctacaacaaccaggacaggcccagcggcatccctgagaggttcagcggaagccccgacagccccttcggaaccacagccaccctgaccatcacaagcgtggaagccggcgacgaggccgactactactgccacatctgggacagcagggtgcccaccaagtgggtgtttggcggcggcaccaccctgaccgtgctggacaaaacccataccgacttcgtgctgacccagagccctcacagcctgagcgtgacacctggcgagagcgccagcatcagctgcaagagcagccactccctgatccacggcgaccggaacaactacctggcttggtacgtgcagaagcccggcagatccccccagctgctgatctacctggccagcagcagagccagcggcgtgcccgatagattttctggcagcggcagcgacaaggacttcaccctgaagatcagccgggtggaaaccgaggacgtgggcacctactactgtatgcagggcagagagagcccctggacctttggccagggcaccaaggtggacatcaaggataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 137 - protein, 451 aa, Artificial Sequence; identical to SEQ ID NO: 81
  Synthetic Construct

SEQ ID NO: 138 - protein, 210 aa, Artificial Sequence; identical to SEQ ID NO: 10
  Synthetic Construct

SEQ ID NO: 139 - protein, 602 aa, Artificial Sequence
  Synthetic Construct
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSDKTHTEVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 140 - protein, 331 aa, Artificial Sequence
  Synthetic Construct
ASELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLDKTHTSDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 141 - DNA, 1356 bp, Artificial Sequence; identical to SEQ ID NO: 61
  Synthetic Construct

SEQ ID NO: 142 - DNA, 630 bp, Artificial Sequence; identical to SEQ ID NO: 14
  Synthetic Construct

SEQ ID NO: 143 - DNA, 1806 bp, Artificial Sequence
  Synthetic Construct
cagatgcagctgcaggagagcggccctggactcgtgaagcccagcgagaccctgagcctgacatgcagcgtgagcggcgccagcatcagcgacagctactggagctggatcaggaggagccctggcaagggcctggagtggatcggctacgtgcacaagagcggcgacaccaactacagcccctccctgaagtccagggtgaacctgtccctggacaccagcaagaaccaggtgagcctgtccctggtggctgccacagctgctgacagcggcaagtactactgtgccaggaccctgcacggcaggaggatctacggcatcgtggccttcaacgagtggttcacctacttctacatggacgtgtggggcaacggcacccaggtgaccgtgagctccgacaaaacccataccgaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtccggctatccccctggcgaggaatattttcaagactggggtcagggaacccttgttatcgtgtcctccgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 144 - DNA, 993 bp, Artificial Sequence
  Synthetic Construct
gcatccgaactgactcaggaccctgccgtctctgtggcactgaagcagactgtgactattacttgccgaggcgactcactgcggagccactacgcttcctggtatcagaagaaacccggccaggcacctgtgctgctgttctacggaaagaacaataggccatctggcatccccgaccgcttttctggcagtgcatcagggaaccgagccagtctgaccattaccggcgcccaggctgaggacgaagccgattactattgcagctcccgggataagagcggctccagactgagcgtgttcggaggaggaactaaactgaccgtcctcgacaaaacccatacctccgacatcagcgtggcccccggagagacagccaggatctcctgcggcgagaagagcctgggaagcagggctgtgcagtggtaccaacacagggccggacaggctcccagcctgatcatctacaacaaccaggacaggcccagcggcatccctgagaggttcagcggaagccccgacagccccttcggaaccacagccaccctgaccatcacaagcgtggaagccggcgacgaggccgactactactgccacatctgggacagcagggtgcccaccaagtgggtgtttggcggcggcaccaccctgaccgtgctggataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 145 - protein, 460 aa, Artificial Sequence
  Synthetic Construct
EVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 146 - protein, 215 aa, Artificial Sequence
  Synthetic Construct
ASELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 147 - protein, 612 aa, Artificial Sequence; identical to SEQ ID NO: 51
  Synthetic Construct

SEQ ID NO: 148 - protein, 334 aa, Artificial Sequence; identical to SEQ ID NO: 52
  Synthetic Construct

SEQ ID NO: 149 - DNA, 1383 bp, Artificial Sequence
  Synthetic Construct
gaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtccggctatccccctggcgaggaatattttcaagactggggtcagggaacccttgttatcgtgtcctccgcgtcgaccaagggccccagcgtgttccctctggcccctagcagcaagagcacatctggcggaacagccgccctgggctgcctcgtgaaggactactttcccgagcccgtgaccgtgtcctggaattctggcgccctgaccagcggcgtgcacacctttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgaaccccaggtgtgcacactgcccccaagcagggacgagctgaccaagaaccaggtgtccctgagctgtgccgtgaaaggcttctacccctccgatatcgccgtggaatgggagagcaacggccagcccgagaacaactacaagaccaccccccctgtgctggacagcgacggctcattcttcctggtgtccaagctgacagtggacaagtcccggtggcagcagggcaacgtgttcagctgctccgtgatgcacgaggccctgcacaaccactacacccagaagtccctgagcctgagccccggcaag

SEQ ID NO: 150 - DNA, 645 bp, Artificial Sequence
  Synthetic Construct
gcatccgaactgactcaggaccctgccgtctctgtggcactgaagcagactgtgactattacttgccgaggcgactcactgcggagccactacgcttcctggtatcagaagaaacccggccaggcacctgtgctgctgttctacggaaagaacaataggccatctggcatccccgaccgcttttctggcagtgcatcagggaaccgagccagtctgaccattaccggcgcccaggctgaggacgaagccgattactattgcagctcccgggataagagcggctccagactgagcgtgttcggaggaggaactaaactgaccgtcctcagtcagcccaaggctgccccctcggtcactctgttcccgccctcgagtgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 151 - DNA, 1836 bp, Artificial Sequence; identical to SEQ ID NO: 55
  Synthetic Construct

SEQ ID NO: 152 - DNA, 1002 bp, Artificial Sequence; identical to SEQ ID NO: 56
  Synthetic Construct

SEQ ID NO: 153 - protein, 451 aa, Artificial Sequence; identical to SEQ ID NO: 81
  Synthetic Construct

SEQ ID NO: 154 - protein, 210 aa, Artificial Sequence; identical to SEQ ID NO: 10
  Synthetic Construct

SEQ ID NO: 155 - protein, 612 aa, Artificial Sequence; identical to SEQ ID NO: 51
  Synthetic Construct

SEQ ID NO: 156 - protein, 334 aa, Artificial Sequence; identical to SEQ ID NO: 52
  Synthetic Construct

SEQ ID NO: 157 - DNA, 1356 bp, Artificial Sequence; identical to SEQ ID NO: 61
  Synthetic Construct

SEQ ID NO: 158 - DNA, 630 bp, Artificial Sequence; identical to SEQ ID NO: 14
  Synthetic Construct

SEQ ID NO: 159 - DNA, 1836 bp, Artificial Sequence; identical to SEQ ID NO: 55
  Synthetic Construct

SEQ ID NO: 160 - DNA, 1002 bp, Artificial Sequence; identical to SEQ ID NO: 56
  Synthetic Construct

SEQ ID NO: 161 - protein, 470 aa, Artificial Sequence; identical to SEQ ID NO: 97
  Synthetic Construct

SEQ ID NO: 162 - protein, 219 aa, Artificial Sequence; identical to SEQ ID NO: 98
  Synthetic Construct

SEQ ID NO: 163 - protein, 592 aa, Artificial Sequence
  Synthetic Construct
EVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSDKTHTRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSADKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 164 - protein, 329 aa, Artificial Sequence
  Synthetic Construct
YIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKDKTHTASELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 165 - DNA, 1413 bp, Artificial Sequence; identical to SEQ ID NO: 101
  Synthetic Construct

SEQ ID NO: 166 - DNA, 657 bp, Artificial Sequence; identical to SEQ ID NO: 102
  Synthetic Construct

SEQ ID NO: 167 - DNA, 1776 bp, Artificial Sequence
  Synthetic Construct
gaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtccggctatccccctggcgaggaatattttcaagactggggtcagggaacccttgttatcgtgtcctccgacaaaacccataccagagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 168 - DNA, 987 bp, Artificial Sequence
  Synthetic Construct
tacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatggcgtgcccagcagattttccggcagcggcttccacaccagcttcaacctgaccatcagcgatctgcaggccgacgacattgccacctactattgtcaggtgctgcagttcttcggcagaggcagcagactgcacatcaaggacaaaacccataccgcatccgaactgactcaggaccctgccgtctctgtggcactgaagcagactgtgactattacttgccgaggcgactcactgcggagccactacgcttcctggtatcagaagaaacccggccaggcacctgtgctgctgttctacggaaagaacaataggccatctggcatccccgaccgcttttctggcagtgcatcagggaaccgagccagtctgaccattaccggcgcccaggctgaggacgaagccgattactattgcagctcccgggataagagcggctccagactgagcgtgttcggaggaggaactaaactgaccgtcctcgataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 169 - protein, 470 aa, Artificial Sequence; identical to SEQ ID NO: 97
  Synthetic Construct

SEQ ID NO: 170 - protein, 219 aa, Artificial Sequence; identical to SEQ ID NO: 98
  Synthetic Construct

SEQ ID NO: 171 - protein, 550 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSADKTHTEVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSF

SEQ ID NO: 172 - protein, 329 aa, Artificial Sequence
  Synthetic Construct
ASELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVLDKTHTYIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 173 - DNA, 1413 bp, Artificial Sequence; identical to SEQ ID NO: 101
  Synthetic Construct

SEQ ID NO: 174 - DNA, 657 bp, Artificial Sequence; identical to SEQ ID NO: 102
  Synthetic Construct

SEQ ID NO: 175 - DNA, 1776 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgacaaaacccataccgaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtccggctatccccctggcgaggaatattttcaagactggggtcagggaacccttgttatcgtgtcctccgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 176 - DNA, 987 bp, Artificial Sequence
  Synthetic Construct
gcatccgaactgactcaggaccctgccgtctctgtggcactgaagcagactgtgactattacttgccgaggcgactcactgcggagccactacgcttcctggtatcagaagaaacccggccaggcacctgtgctgctgttctacggaaagaacaataggccatctggcatccccgaccgcttttctggcagtgcatcagggaaccgagccagtctgaccattaccggcgcccaggctgaggacgaagccgattactattgcagctcccgggataagagcggctccagactgagcgtgttcggaggaggaactaaactgaccgtcctcgacaaaacccatacctacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatggcgtgcccagcagattttccggcagcggcttccacaccagcttcaacctgaccatcagcgatctgcaggccgacgacattgccacctactattgtcaggtgctgcagttcttcggcagaggcagcagactgcacatcaaggataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 177 - protein, 460 aa, Artificial Sequence; identical to SEQ ID NO: 145
  Synthetic Construct

SEQ ID NO: 178 - protein, 215 aa, Artificial Sequence; identical to SEQ ID NO: 146
  Synthetic Construct

SEQ ID NO: 179 - protein, 602 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSADKTHTQVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 180 - protein, 332 aa, Artificial Sequence
  Synthetic Construct
DFVLTQSPHSLSVTPGESASISCKSSHSLIHGDRNNYLAWYVQKPGRSPQLLIYLASSRASGVPDRFSGSGSDKDFTLKISRVETEDVGTYYCMQGRESPWTFGQGTKVDIKDKTHTYIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 181 - DNA, 1383 bp, Artificial Sequence; identical to SEQ ID NO: 149
  Synthetic Construct

SEQ ID NO: 182 - DNA, 645 bp, Artificial Sequence; identical to SEQ ID NO: 150
  Synthetic Construct

SEQ ID NO: 183 - DNA, 1806 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgacaaaacccatacccaggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctgataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgatgcatgaggctctgcacaaccactacacgcagaagagcctctccctgtctccgggt

SEQ ID NO: 184 - DNA, 996 bp, Artificial Sequence
  Synthetic Construct
gacttcgtgctgacccagagccctcacagcctgagcgtgacacctggcgagagcgccagcatcagctgcaagagcagccactccctgatccacggcgaccggaacaactacctggcttggtacgtgcagaagcccggcagatccccccagctgctgatctacctggccagcagcagagccagcggcgtgcccgatagattttctggcagcggcagcgacaaggacttcaccctgaagatcagccgggtggaaaccgaggacgtgggcacctactactgtatgcagggcagagagagcccctggacctttggccagggcaccaaggtggacatcaaggacaaaacccatacctacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatggcgtgcccagcagattttccggcagcggcttccacaccagcttcaacctgaccatcagcgatctgcaggccgacgacattgccacctactattgtcaggtgctgcagttcttcggcagaggcagcagactgcacatcaaggataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 185 - protein, 460 aa, Artificial Sequence; identical to SEQ ID NO: 145
  Synthetic Construct

SEQ ID NO: 186 - protein, 215 aa, Artificial Sequence; identical to SEQ ID NO: 146
  Synthetic Construct

SEQ ID NO: 187 - protein, 602 aa, Artificial Sequence
  Synthetic Construct
QVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSDKTHTRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSADKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 188 - protein, 332 aa, Artificial Sequence
  Synthetic Construct
YIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKDKTHTDFVLTQSPHSLSVTPGESASISCKSSHSLIHGDRNNYLAWYVQKPGRSPQLLIYLASSRASGVPDRFSGSGSDKDFTLKISRVETEDVGTYYCMQGRESPWTFGQGTKVDIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 189 - DNA, 1383 bp, Artificial Sequence; identical to SEQ ID NO: 149
  Synthetic Construct

SEQ ID NO: 190 - DNA, 645 bp, Artificial Sequence; identical to SEQ ID NO: 150
  Synthetic Construct

SEQ ID NO: 191 - DNA, 996 bp, Artificial Sequence
  Synthetic Construct
tacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatggcgtgcccagcagattttccggcagcggcttccacaccagcttcaacctgaccatcagcgatctgcaggccgacgacattgccacctactattgtcaggtgctgcagttcttcggcagaggcagcagactgcacatcaaggacaaaacccataccgacttcgtgctgacccagagccctcacagcctgagcgtgacacctggcgagagcgccagcatcagctgcaagagcagccactccctgatccacggcgaccggaacaactacctggcttggtacgtgcagaagcccggcagatccccccagctgctgatctacctggccagcagcagagccagcggcgtgcccgatagattttctggcagcggcagcgacaaggacttcaccctgaagatcagccgggtggaaaccgaggacgtgggcacctactactgtatgcagggcagagagagcccctggacctttggccagggcaccaaggtggacatcaaggataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 192 - DNA, 996 bp, Artificial Sequence; identical to SEQ ID NO: 191
  Synthetic Construct

SEQ ID NO: 193 - protein, 450 aa, Artificial Sequence; identical to SEQ ID NO: 1
  Synthetic Construct

SEQ ID NO: 194 - protein, 210 aa, Artificial Sequence; identical to SEQ ID NO: 2
  Synthetic Construct

SEQ ID NO: 195 - protein, 615 aa, Artificial Sequence
  Synthetic Construct
EVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSSDKTHTQVQLVESGGGVVQPGTSLRLSCAASQFRFDGYGMHWVRQAPGKGLEWVASISHDGIKKYHAEKVWGRFTISRDNSKNTLYLQMNSLRPEDTALYYCAKDLREDECEEWWSDYYDFGKQLPCAKSRGGLVGIADNWGQGTMVTVSSDKTHTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVLHEALHSHYTQKSLSLSPG

SEQ ID NO: 196 - protein, 337 aa, Artificial Sequence; identical to SEQ ID NO: 60
  Synthetic Construct

SEQ ID NO: 197 - DNA, 1350 bp, Artificial Sequence
  Synthetic Construct
caggtgcagctggtgcagtctggcggccagatgaagaaacccggcgagagcatgcggatcagctgcagagccagcggctacgagttcatcgactgcaccctgaactggatcagactggcccctggcaagcggcctgagtggatgggatggctgaagcctagaggcggagccgtgaactacgccagacctctgcagggcagagtgaccatgacccgggacgtgtacagcgataccgccttcctggaactgcggagcctgaccgtggatgataccgccgtgtacttctgcacccggggcaagaactgcgactacaactgggacttcgagcactggggcagaggcacccctgtgatcgtgtcaagcgcgtcgaccaagggccccagcgtgttccctctggcccctagcagcaagagcacatctggcggaacagccgccctgggctgcctcgtgaaggactactttcccgagcccgtgaccgtgtcctggaattctggcgccctgaccagcggcgtgcacacctttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgaaccccaggtgtgcacactgcccccaagcagggacgagctgaccaagaaccaggtgtccctgagctgtgccgtgaaaggcttctacccctccgatatcgccgtggaatgggagagcaacggccagcccgagaacaactacaagaccaccccccctgtgctggacagcgacggctcattcttcctggtgtccaagctgacagtggacaagtcccggtggcagcagggcaacgtgttcagctgctccgtgctgcatgaggctctgcacagccactacacgcagaagagcctctccctgtctccgggt

SEQ ID NO: 198 - DNA, 630 bp, Artificial Sequence; identical to SEQ ID NO: 6
  Synthetic Construct

SEQ ID NO: 199 - DNA, 1845 bp, Artificial Sequence
  Synthetic Construct
gaggttagactggtggagtcaggaggggggcttgtgaagcccggtgggtctctccgcctgagctgttctgcctccggctttgatttcgataacgcctggatgacctgggtcaggcagcctccaggtaagggactggagtgggtgggaagaatcacaggtccaggcgagggctggtccgtggactacgcggaatctgttaaagggcggtttacaatctcaagggacaataccaagaataccttgtatttggagatgaacaacgtgagaactgaagacaccggatattacttctgtgccagaacaggcaaatactacgacttctggtccggctatccccctggcgaggaatattttcaagactggggtcagggaacccttgttatcgtgtcctccgacaaaacccatacccaggtgcagttggtggagtctgggggaggcgtggtccagcctgggacgtccctgagactctcctgtgcagcctctcaattcaggtttgatggttatggcatgcactgggtccgccaggccccaggcaaggggctggagtgggtggcatctatatcacatgatggaattaaaaagtatcacgcagaaaaagtgtggggccgcttcaccatctccagagacaattccaagaacacactgtatctacaaatgaacagcctgcgacctgaggacacggctctctactactgtgcgaaagatttgcgagaagacgaatgtgaagagtggtggtcggattattacgattttgggaaacaactcccttgcgcaaagtcacgcggcggcttggttggaattgctgataactggggccaagggacaatggtcaccgtctcttcagataagacccacaccgcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgttgacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaatcaagtcagcctgtggtgcctggtaaaaggcttctatcccagcgacatcgccgtggagtgggagagcaatgggcagccggagaacaactacaagaccacgcctcccgtgctggactccgacggctccttcttcctctactcaaaactcaccgtggacaagagcaggtggcagcaggggaacgtcttctcatgctccgtgctgcatgaggctctgcacagccactacacgcagaagagcctctccctgtctccgggt

SEQ ID NO: 200 - DNA, 1011 bp, Artificial Sequence; identical to SEQ ID NO: 64
  Synthetic Construct

SEQ ID NO: 201 - protein, 451 aa, Artificial Sequence; identical to SEQ ID NO: 9
  Synthetic Construct

SEQ ID NO: 202 - protein, 210 aa, Artificial Sequence; identical to SEQ ID NO: 10
  Synthetic Construct

SEQ ID NO: 203 - protein, 615 aa, Artificial Sequence; identical to SEQ ID NO: 195
  Synthetic Construct

SEQ ID NO: 204 - protein, 337 aa, Artificial Sequence; identical to SEQ ID NO: 60
  Synthetic Construct

SEQ ID NO: 205 - DNA, 1353 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgcctctacaaagggccccagcgtgttccctctggcccctagcagcaagagcacatctggcggaacagccgccctgggctgcctcgtgaaggactactttcccgagcccgtgaccgtgtcctggaattctggcgccctgaccagcggcgtgcacacctttccagctgtgctgcagtccagcggcctgtacagcctgagcagcgtcgtgacagtgcccagcagctctctgggcacccagacctacatctgcaacgtgaaccacaagcccagcaacaccaaggtggacaagaaggtggaacccaagagctgcgacaagacccacacctgtcccccttgtcctgcccccgaactgctgggaggcccttccgtgttcctgttccccccaaagcccaaggacaccctgatgatcagccggacccccgaagtgacctgcgtggtggtggatgtgtcccacgaggaccctgaagtgaagttcaattggtacgtggacggcgtggaagtgcacaacgccaagaccaagccaagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgaaccccaggtgtgcacactgcccccaagcagggacgagctgaccaagaaccaggtgtccctgagctgtgccgtgaaaggcttctacccctccgatatcgccgtggaatgggagagcaacggccagcccgagaacaactacaagaccaccccccctgtgctggacagcgacggctcattcttcctggtgtccaagctgacagtggacaagtcccggtggcagcagggcaacgtgttcagctgctccgtgctgcatgaggctctgcacagccactacacgcagaagagcctctccctgtctccgggt

SEQ ID NO: 206 - DNA, 630 bp, Artificial Sequence; identical to SEQ ID NO: 14
  Synthetic Construct

SEQ ID NO: 207 - DNA, 1845 bp, Artificial Sequence; identical to SEQ ID NO: 199
  Synthetic Construct

SEQ ID NO: 208 - DNA, 1011 bp, Artificial Sequence; identical to SEQ ID NO: 64
  Synthetic Construct

SEQ ID NO: 209 - protein, 451 aa, Artificial Sequence; identical to SEQ ID NO: 9
  Synthetic Construct

SEQ ID NO: 210 - protein, 210 aa, Artificial Sequence
  Synthetic Construct
YIHVTQSPSSLSVSIGDRVTINCQTSQGVGSDLHWYQHKPGRAPKLLIHHTSSVEDGVPSRFSGSGFHTSFQLTISDLQADDIATYYCQVLQFFGRGSRLHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 211 - protein, 611 aa, Artificial Sequence; identical to SEQ ID NO: 3
  Synthetic Construct

SEQ ID NO: 212 - protein, 338 aa, Artificial Sequence [sequence omitted]

SEQ ID NO: 213 - DNA, 1353 bp, Artificial Sequence; identical to SEQ ID NO: 13
  Synthetic Construct

SEQ ID NO: 214 - DNA, 630 bp, Artificial Sequence
  Synthetic Construct
tacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatggcgtgcccagcagattttccggcagcggcttccacaccagcttccagctgaccatcagcgatctgcaggccgacgacattgccacctactattgtcaggtgctgcagttcttcggcagaggcagcagactgcacatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 215 - DNA, 1833 bp, Artificial Sequence; identical to SEQ ID NO: 7
  Synthetic Construct

SEQ ID NO: 216 - DNA, 1014 bp, Artificial Sequence; identical to SEQ ID NO: 8
  Synthetic Construct

SEQ ID NO: 217 - protein, 451 aa, Artificial Sequence; identical to SEQ ID NO: 9
  Synthetic Construct

SEQ ID NO: 218 - protein, 210 aa, Artificial Sequence
  Synthetic Construct
YIHVTQSPSSLSVSIGDRVTINCQTSQGVGSDLHWYQHKPGRAPKLLIHHTSSVEEGVPSRFSGSGFHTSFNLTISDLQADDIATYYCQVLQFFGRGSRLHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 219 - protein, 611 aa, Artificial Sequence; identical to SEQ ID NO: 3
  Synthetic Construct

SEQ ID NO: 220 - protein, 338 aa, Artificial Sequence [sequence omitted]

SEQ ID NO: 221 - DNA, 1353 bp, Artificial Sequence; identical to SEQ ID NO: 13
  Synthetic Construct

SEQ ID NO: 222 - DNA, 630 bp, Artificial Sequence
  Synthetic Construct
tacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagaaggcgtgcccagcagattttccggcagcggcttccacaccagcttcaacctgaccatcagcgatctgcaggccgacgacattgccacctactattgtcaggtgctgcagttcttcggcagaggcagcagactgcacatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 223 - DNA, 1833 bp, Artificial Sequence; identical to SEQ ID NO: 7
  Synthetic Construct

SEQ ID NO: 224 - DNA, 1014 bp, Artificial Sequence; identical to SEQ ID NO: 8
  Synthetic Construct

SEQ ID NO: 225 - protein, 451 aa, Artificial Sequence; identical to SEQ ID NO: 9
  Synthetic Construct

SEQ ID NO: 226 - protein, 210 aa, Artificial Sequence
  Synthetic Construct
YIHVTQSPSSLSVSIGDRVTINCQTSQGVGSDLHWYQHKPGRAPKLLIHHTSSVEDAVPSRFSGSGFHTSFNLTISDLQADDIATYYCQVLQFFGRGSRLHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 227 - protein, 611 aa, Artificial Sequence; identical to SEQ ID NO: 3
  Synthetic Construct

SEQ ID NO: 228 - protein, 338 aa, Artificial Sequence [sequence omitted]

SEQ ID NO: 229 - DNA, 1353 bp, Artificial Sequence; identical to SEQ ID NO: 13
  Synthetic Construct

SEQ ID NO: 230 - DNA, 630 bp, Artificial Sequence
  Synthetic Construct
tacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatgccgtgcccagcagattttccggcagcggcttccacaccagcttcaacctgaccatcagcgatctgcaggccgacgacattgccacctactattgtcaggtgctgcagttcttcggcagaggcagcagactgcacatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 231 - DNA, 1833 bp, Artificial Sequence; identical to SEQ ID NO: 7
  Synthetic Construct

SEQ ID NO: 232 - protein, 451 aa, Artificial Sequence; identical to SEQ ID NO: 9
  Synthetic Construct

SEQ ID NO: 233 - protein, 210 aa, Artificial Sequence
  Synthetic Construct
YIHVTQSPSSLSVSIGDRVTINCQTSQGVGSDLHWYQHKPGRAPKLLIHHTSSVEEGVPSRFSGSGFHTSFQLTISDLQADDIATYYCQVLQFFGRGSRLHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 234 - protein, 611 aa, Artificial Sequence; identical to SEQ ID NO: 3
  Synthetic Construct

SEQ ID NO: 235 - protein, 338 aa, Artificial Sequence [sequence omitted]

SEQ ID NO: 236 - DNA, 1353 bp, Artificial Sequence; identical to SEQ ID NO: 13
  Synthetic Construct

SEQ ID NO: 237 - DNA, 630 bp, Artificial Sequence
  Synthetic Construct
tacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagaaggcgtgcccagcagattttccggcagcggcttccacaccagcttccagctgaccatcagcgatctgcaggccgacgacattgccacctactattgtcaggtgctgcagttcttcggcagaggcagcagactgcacatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 238 - DNA, 1833 bp, Artificial Sequence; identical to SEQ ID NO: 7
  Synthetic Construct

SEQ ID NO: 239 - DNA, 1014 bp, Artificial Sequence; identical to SEQ ID NO: 8
  Synthetic Construct

SEQ ID NO: 240 - protein, 451 aa, Artificial Sequence; identical to SEQ ID NO: 9
  Synthetic Construct

SEQ ID NO: 241 - protein, 210 aa, Artificial Sequence
  Synthetic Construct
YIHVTQSPSSLSVSIGDRVTINCQTSQGVGSDLHWYQHKPGRAPKLLIHHTSSVEDAVPSRFSGSGFHTSFQLTISDLQADDIATYYCQVLQFFGRGSRLHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 242 - protein, 611 aa, Artificial Sequence; identical to SEQ ID NO: 3
  Synthetic Construct

SEQ ID NO: 243 - protein, 338 aa, Artificial Sequence [sequence omitted]

SEQ ID NO: 244 - DNA, 1353 bp, Artificial Sequence; identical to SEQ ID NO: 13
  Synthetic Construct

SEQ ID NO: 245 - DNA, 630 bp, Artificial Sequence
  Synthetic Construct
tacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatgccgtgcccagcagattttccggcagcggcttccacaccagcttccagctgaccatcagcgatctgcaggccgacgacattgccacctactattgtcaggtgctgcagttcttcggcagaggcagcagactgcacatcaagcgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 246 - DNA, 1833 bp, Artificial Sequence; identical to SEQ ID NO: 7
  Synthetic Construct

SEQ ID NO: 247 - DNA, 1014 bp, Artificial Sequence; identical to SEQ ID NO: 8
  Synthetic Construct

SEQ ID NO: 248 - protein, 5 aa, Artificial Sequence
  Synthetic Construct
DCTLN

SEQ ID NO: 249 - protein, 17 aa, Artificial Sequence
  Synthetic Construct
WLKPRGGAVNYARPLQG

SEQ ID NO: 250 - protein, 12 aa, Artificial Sequence
  Synthetic Construct
GKNCDYNWDFEH

SEQ ID NO: 251 - protein, 8 aa, Artificial Sequence
  Synthetic Construct
GYTFTAHI

SEQ ID NO: 252 - protein, 8 aa, Artificial Sequence
  Synthetic Construct
IKPQYGAV

SEQ ID NO: 253 - protein, 13 aa, Artificial Sequence
  Synthetic Construct
DRSYGDSSWALDA

SEQ ID NO: 254 - protein, 8 aa, Artificial Sequence
  Synthetic Construct
GFDFDNAW

SEQ ID NO: 255 - protein, 10 aa, Artificial Sequence
  Synthetic Construct
ITGPGEGWSV

SEQ ID NO: 256 - protein, 20 aa, Artificial Sequence
  Synthetic Construct
TGKYYDFWSGYPPGEEYFQD

SEQ ID NO: 257 - protein, 8 aa, Artificial Sequence
  Synthetic Construct
GNTLKTYD

SEQ ID NO: 258 - protein, 8 aa, Artificial Sequence
  Synthetic Construct
ISHEGDKK

SEQ ID NO: 259 - protein, 36 aa, Artificial Sequence
  Synthetic Construct
CAKGSKHRLRDYALYDDDGALNWAVDVDYLSNLEFW

SEQ ID NO: 260 - protein, 9 aa, Artificial Sequence
  Synthetic Construct
SGASISDSY

SEQ ID NO: 261 - protein, 7 aa, Artificial Sequence
  Synthetic Construct
VHKSGDT

SEQ ID NO: 262 - protein, 26 aa, Artificial Sequence
  Synthetic Construct
ARTLHGRRIYGIVAFNEWFTYFYMDV

SEQ ID NO: 263 - protein, 8 aa, Artificial Sequence
  Synthetic Construct
QFRFDGYG

SEQ ID NO: 264 - protein, 8 aa, Artificial Sequence
  Synthetic Construct
ISHDGIKK

SEQ ID NO: 265 - protein, 40 aa, Artificial Sequence
  Synthetic Construct
CAKDLREDECEEWWSDYYDFGKQLPCAKSRGGLVGIADNW

SEQ ID NO: 266 - protein, 9 aa, Artificial Sequence
  Synthetic Construct
RTSQYGSLA

SEQ ID NO: 267 - protein, 7 aa, Artificial Sequence
  Synthetic Construct
SGSTRAA

SEQ ID NO: 268 - protein, 5 aa, Artificial Sequence
  Synthetic Construct
QQYEF

SEQ ID NO: 269 - protein, 6 aa, Artificial Sequence
  Synthetic Construct
QGVGSD

SEQ ID NO: 270 - protein, 3 aa, Artificial Sequence
  Synthetic Construct
HTS

SEQ ID NO: 271 - protein, 5 aa, Artificial Sequence
  Synthetic Construct
QVLQF

SEQ ID NO: 272 - protein, 11 aa, Artificial Sequence
  Synthetic Construct
RGDSLRSHYAS

SEQ ID NO: 273 - protein, 7 aa, Artificial Sequence
  Synthetic Construct
GKNNRPS

SEQ ID NO: 274 - protein, 12 aa, Artificial Sequence
  Synthetic Construct
SSRDKSGSRLSV

SEQ ID NO: 275 - protein, 11 aa, Artificial Sequence
  Synthetic Construct
HSLIHGDRNNY

SEQ ID NO: 276 - protein, 3 aa, Artificial Sequence
  Synthetic Construct
LAS

SEQ ID NO: 277 - protein, 11 aa, Artificial Sequence
  Synthetic Construct
CMQGRESPWTF

SEQ ID NO: 278 - protein, 6 aa, Artificial Sequence
  Synthetic Construct
SLGSRA

SEQ ID NO: 279 - protein, 3 aa, Artificial Sequence
  Synthetic Construct
NNQ

SEQ ID NO: 280 - protein, 12 aa, Artificial Sequence
  Synthetic Construct
HIWDSRVPTKWV

SEQ ID NO: 281 - protein, 8 aa, Artificial Sequence
  Synthetic Construct
TSNIGNNF

SEQ ID NO: 282 - protein, 3 aa, Artificial Sequence
  Synthetic Construct
ETD

SEQ ID NO: 283 - protein, 12 aa, Artificial Sequence
  Synthetic Construct
ATWAASLSSARV

SEQ ID NO: 284 - protein, 33 aa, Artificial Sequence
  Synthetic Construct
RRRNEQELLELDKWASLWNWFDITNWLWYIRRR

SEQ ID NO: 285 - protein, 4 aa, Artificial Sequence
  Synthetic Construct
GGGG

SEQ ID NO: 286 - protein, 5 aa, Artificial Sequence
  Synthetic Construct
GGGGG

SEQ ID NO: 287 - protein, 6 aa, Artificial Sequence
  Synthetic Construct
GGGGGG

SEQ ID NO: 288 - protein, 7 aa, Artificial Sequence
  Synthetic Construct
GGGGGGG

SEQ ID NO: 289 - protein, 8 aa, Artificial Sequence
  Synthetic Construct
GGGGGGGG

SEQ ID NO: 290 - protein, 5 aa, Artificial Sequence
  Synthetic Construct
GGGGS

SEQ ID NO: 291 - protein, 10 aa, Artificial Sequence
  Synthetic Construct
GGGGSGGGGS

SEQ ID NO: 292 - protein, 15 aa, Artificial Sequence
  Synthetic Construct
GGGGSGGGGSGGGGS

SEQ ID NO: 293 - protein, 5 aa, Artificial Sequence
  Synthetic Construct
TKGPS

SEQ ID NO: 294 - protein, 5 aa, Artificial Sequence
  Synthetic Construct
TVAAP

SEQ ID NO: 295 - protein, 5 aa, Artificial Sequence
  Synthetic Construct
QPKAA

SEQ ID NO: 296 - protein, 5 aa, Artificial Sequence
  Synthetic Construct
QRIEG

SEQ ID NO: 297 - protein, 7 aa, Artificial Sequence
  Synthetic Construct
ASTKGPS

SEQ ID NO: 298 - protein, 7 aa, Artificial Sequence
  Synthetic Construct
RTVAAPS

SEQ ID NO: 299 - protein, 7 aa, Artificial Sequence
  Synthetic Construct
GQPKAAP

SEQ ID NO: 300 - protein, 7 aa, Artificial Sequence
  Synthetic Construct
HIDSPNK

SEQ ID NO: 301 - DNA, 1014 bp, Artificial Sequence; identical to SEQ ID NO: 8
  Synthetic Construct

SEQ ID NO: 302 - protein, 449 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLGK

SEQ ID NO: 303 - protein, 210 aa, Artificial Sequence; identical to SEQ ID NO: 10
  Synthetic Construct

SEQ ID NO: 304 - protein, 571 aa, Artificial Sequence
  Synthetic Construct
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSSQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSRTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLGK

SEQ ID NO: 305 - protein, 338 aa, Artificial Sequence
  Synthetic Construct
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGQPKAAPDIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKTKGPSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 306 - DNA, 1347 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgcctctacaaagggcccctcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggcaag

SEQ ID NO: 307 - DNA, 630 bp, Artificial Sequence; identical to SEQ ID NO: 14
  Synthetic Construct

SEQ ID NO: 308 - DNA, 1713 bp, Artificial Sequence
  Synthetic Construct
caggtgcagctggtgcagtctggcgccgaggtcgtgaaacctggcgcctctgtgaaggtgtcctgcaaggccagcggctacacctttaccagctactacatccactgggtgcgccaggcccctggacagggactggaatggatcggcagcatctaccccggcaacgtgaacaccaactacgcccagaagttccagggcagagccaccctgaccgtggacaccagcatcagcaccgcctacatggaactgagccggctgagaagcgacgacaccgccgtgtactactgcacccggtcccactacggcctggattggaacttcgacgtgtggggcaagggcaccaccgtgacagtgtctagcagccaggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtcggaccgccagcacaaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggcaag

SEQ ID NO: 309 - DNA, 1014 bp, Artificial Sequence
  Synthetic Construct
gacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaagggccagcccaaggccgcccccgacatccagatgacccagagccccagcagcctgtctgccagcgtgggcgacagagtgaccatcacctgtcaggccagccagaacatctacgtgtggctgaactggtatcagcagaagcccggcaaggcccccaagctgctgatctacaaggccagcaacctgcacaccggcgtgcccagcagattttctggcagcggctccggcaccgacttcaccctgacaatcagctccctgcagcccgaggacattgccacctactactgccagcagggccagacctacccctacacctttggccagggcaccaagctggaaatcaagaccaagggccccagccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 310 - protein, 449 aa, Artificial Sequence; identical to SEQ ID NO: 302
  Synthetic Construct

SEQ ID NO: 311 - protein, 210 aa, Artificial Sequence; identical to SEQ ID NO: 10
  Synthetic Construct

SEQ ID NO: 312 - protein, 571 aa, Artificial Sequence
  Synthetic Construct
QVQLQESGPGLVKPSQTLSLTCTVSGFSLSDYGVHWVRQPPGKGLEWLGVIWAGGGTNYNPSLKSRKTISKDTSKNQVSLKLSSVTAADTAVYYCARDKGYSYYYSMDYWGQGTTVTVSSSQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSRTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLGK

SEQ ID NO: 313 - protein, 342 aa, Artificial Sequence
  Synthetic Construct
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGQPKAAPDIVLTQSPASLAVSPGQRATITCRASESVEYYVTSLMQWYQQKPGQPPKLLIFAASNVESGVPARFSGSGSGTDFTLTINPVEANDVANYYCQQSRKVPYTFGQGTKLEIKTKGPSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 314 - DNA, 1347 bp, Artificial Sequence; identical to SEQ ID NO: 306
  Synthetic Construct

SEQ ID NO: 315 - DNA, 630 bp, Artificial Sequence; identical to SEQ ID NO: 14
  Synthetic Construct

SEQ ID NO: 316 - DNA, 1713 bp, Artificial Sequence
  Synthetic Construct
caggtgcagctgcaggaatctggccctggcctcgtgaagcctagccagaccctgagcctgacctgtaccgtgtccggcttcagcctgagcgactacggcgtgcactgggtgcgccagccacctggaaaaggcctggaatggctgggcgtgatctgggctggcggaggcaccaactacaaccccagcctgaagtccagaaagaccatcagcaaggacaccagcaagaaccaggtgtccctgaagctgagcagcgtgacagccgccgataccgccgtgtactactgcgccagagacaagggctacagctactactacagcatggactactggggccagggcaccaccgtgaccgtgtcatcctctcaggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtcggaccgcttcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggcaag

SEQ ID NO: 317 - DNA, 1026 bp, Artificial Sequence
  Synthetic Construct
gacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaagggccagcccaaggccgcccccgacatcgtgctgacacagagccctgctagcctggccgtgtctcctggacagagggccaccatcacctgtagagccagcgagagcgtggaatattacgtgaccagcctgatgcagtggtatcagcagaagcccggccagccccccaagctgctgattttcgccgccagcaacgtggaaagcggcgtgccagccagattttccggcagcggctctggcaccgacttcaccctgaccatcaaccccgtggaagccaacgacgtggccaactactactgccagcagagccggaaggtgccctacacctttggccagggcaccaagctggaaatcaagaccaagggccccagccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 318 - protein, 468 aa, Artificial Sequence
  Synthetic Construct
QVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLGK

SEQ ID NO: 319 - protein, 219 aa, Artificial Sequence; identical to SEQ ID NO: 98
  Synthetic Construct

SEQ ID NO: 320 - protein, 571 aa, Artificial Sequence; identical to SEQ ID NO: 304
  Synthetic Construct

SEQ ID NO: 321 - protein, 338 aa, Artificial Sequence; identical to SEQ ID NO: 305
  Synthetic Construct

SEQ ID NO: 322 - DNA, 1404 bp, Artificial Sequence
  Synthetic Construct
caggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctgcttcgaccaagggcccctcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggcaag

SEQ ID NO: 323 - DNA, 657 bp, Artificial Sequence; identical to SEQ ID NO: 102
  Synthetic Construct

SEQ ID NO: 324 - DNA, 1713 bp, Artificial Sequence; identical to SEQ ID NO: 308
  Synthetic Construct

SEQ ID NO: 325 - DNA, 1014 bp, Artificial Sequence; identical to SEQ ID NO: 309
  Synthetic Construct

SEQ ID NO: 326 - protein, 468 aa, Artificial Sequence; identical to SEQ ID NO: 318
  Synthetic Construct

SEQ ID NO: 327 - protein, 219 aa, Artificial Sequence; identical to SEQ ID NO: 98
  Synthetic Construct

SEQ ID NO: 328 - protein, 571 aa, Artificial Sequence; identical to SEQ ID NO: 312
  Synthetic Construct

SEQ ID NO: 329 - protein, 342 aa, Artificial Sequence; identical to SEQ ID NO: 313
  Synthetic Construct

SEQ ID NO: 330 - DNA, 1404 bp, Artificial Sequence; identical to SEQ ID NO: 322
  Synthetic Construct

SEQ ID NO: 331 - DNA, 657 bp, Artificial Sequence; identical to SEQ ID NO: 102
  Synthetic Construct

SEQ ID NO: 332 - DNA, 1713 bp, Artificial Sequence; identical to SEQ ID NO: 316
  Synthetic Construct

SEQ ID NO: 333 - DNA, 1026 bp, Artificial Sequence; identical to SEQ ID NO: 317
  Synthetic Construct

SEQ ID NO: 334 - protein, 448 aa, Artificial Sequence
  Synthetic Construct
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLGK

SEQ ID NO: 335 - protein, 210 aa, Artificial Sequence; identical to SEQ ID NO: 2
  Synthetic Construct

SEQ ID NO: 336 - protein, 571 aa, Artificial Sequence; identical to SEQ ID NO: 304
  Synthetic Construct

SEQ ID NO: 337 - protein, 338 aa, Artificial Sequence; identical to SEQ ID NO: 305
  Synthetic Construct

SEQ ID NO: 338 - DNA, 1344 bp, Artificial Sequence
  Synthetic Construct
caggtgcagctggtgcagtctggcggccagatgaagaaacccggcgagagcatgcggatcagctgcagagccagcggctacgagttcatcgactgcaccctgaactggatcagactggcccctggcaagcggcctgagtggatgggatggctgaagcctagaggcggagccgtgaactacgccagacctctgcagggcagagtgaccatgacccgggacgtgtacagcgataccgccttcctggaactgcggagcctgaccgtggatgataccgccgtgtacttctgcacccggggcaagaactgcgactacaactgggacttcgagcactggggcagaggcacccctgtgatcgtgtcaagcgcgtcgaccaagggcccctcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggcaag

SEQ ID NO: 339 - DNA, 630 bp, Artificial Sequence; identical to SEQ ID NO: 6
  Synthetic Construct

SEQ ID NO: 340 - DNA, 1713 bp, Artificial Sequence; identical to SEQ ID NO: 308
  Synthetic Construct

SEQ ID NO: 341 - DNA, 1014 bp, Artificial Sequence; identical to SEQ ID NO: 309
  Synthetic Construct

SEQ ID NO: 342 - protein, 448 aa, Artificial Sequence; identical to SEQ ID NO: 334
  Synthetic Construct

SEQ ID NO: 343 - protein, 210 aa, Artificial Sequence; identical to SEQ ID NO: 2
  Synthetic Construct

SEQ ID NO: 344 - protein, 571 aa, Artificial Sequence; identical to SEQ ID NO: 312
  Synthetic Construct

SEQ ID NO: 345 - protein, 342 aa, Artificial Sequence; identical to SEQ ID NO: 313
  Synthetic Construct

SEQ ID NO: 346 - DNA, 1344 bp, Artificial Sequence; identical to SEQ ID NO: 338
  Synthetic Construct

SEQ ID NO: 347 - DNA, 630 bp, Artificial Sequence; identical to SEQ ID NO: 6
  Synthetic Construct

SEQ ID NO: 348 - DNA, 1713 bp, Artificial Sequence; identical to SEQ ID NO: 316
  Synthetic Construct

SEQ ID NO: 349 - DNA, 1026 bp, Artificial Sequence; identical to SEQ ID NO: 317
  Synthetic Construct

SEQ ID NO: 350 - protein, 447 aa, Artificial Sequence
  Synthetic Construct
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLGK

SEQ ID NO: 351 - protein, 214 aa, Artificial Sequence
  Synthetic Construct
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 352 - protein, 573 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSASQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSRTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLGK

SEQ ID NO: 353 - protein, 334 aa, Artificial Sequence
  Synthetic Construct
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGQPKAAPYIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKTKGPSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 354 - DNA, 1341 bp, Artificial Sequence
  Synthetic Construct
caggtgcagctggtgcagtctggcgccgaggtcgtgaaacctggcgcctctgtgaaggtgtcctgcaaggccagcggctacacctttaccagctactacatccactgggtgcgccaggcccctggacagggactggaatggatcggcagcatctaccccggcaacgtgaacaccaactacgcccagaagttccagggcagagccaccctgaccgtggacaccagcatcagcaccgcctacatggaactgagccggctgagaagcgacgacaccgccgtgtactactgcacccggtcccactacggcctggattggaacttcgacgtgtggggcaagggcaccaccgtgacagtgtctagcgcgtcgaccaagggcccctcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggcaag

SEQ ID NO: 355 - DNA, 642 bp, Artificial Sequence
  Synthetic Construct
gacatccagatgacccagagccccagcagcctgtctgccagcgtgggcgacagagtgaccatcacctgtcaggccagccagaacatctacgtgtggctgaactggtatcagcagaagcccggcaaggcccccaagctgctgatctacaaggccagcaacctgcacaccggcgtgcccagcagattttctggcagcggctccggcaccgacttcaccctgacaatcagctccctgcagcccgaggacattgccacctactactgccagcagggccagacctacccctacacctttggccagggcaccaagctggaaatcaagcgtacggtggccgctcccagcgtgttcatcttcccacctagcgacgagcagctgaagtccggcacagcctctgtcgtgtgcctgctgaacaacttctacccccgcgaggccaaggtgcagtggaaggtggacaatgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtctagccccgtgaccaagagcttcaaccggggcgagtgt

SEQ ID NO: 356 - DNA, 1719 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgcctctcaggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtcggaccgcttcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggcaag

SEQ ID NO: 357 - DNA, 1002 bp, Artificial Sequence
  Synthetic Construct
gacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaagggccagcccaaggccgccccctacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatggcgtgcccagcagattttccggcagcggcttccacaccagcttcaacctgaccatcagcgatctgcaggccgacgacattgccacctactattgtcaggtgctgcagttcttcggcagaggcagcagactgcacatcaagaccaagggccccagccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 358 - protein, 447 aa, Artificial Sequence; identical to SEQ ID NO: 350
  Synthetic Construct

SEQ ID NO: 359 - protein, 214 aa, Artificial Sequence; identical to SEQ ID NO: 351
  Synthetic Construct

SEQ ID NO: 360 - protein, 580 aa, Artificial Sequence
  Synthetic Construct
RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSADKTHTQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLGK

SEQ ID NO: 361 - protein, 332 aa, Artificial Sequence
  Synthetic Construct
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKDKTHTYIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 362 - DNA, 1341 bp, Artificial Sequence; identical to SEQ ID NO: 354
  Synthetic Construct

SEQ ID NO: 363 - DNA, 642 bp, Artificial Sequence; identical to SEQ ID NO: 355
  Synthetic Construct

SEQ ID NO: 364 - DNA, 1740 bp, Artificial Sequence
  Synthetic Construct
agagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgacaaaacccatacccaggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtgataagacccacaccgcttcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggcaag

SEQ ID NO: 365 - DNA, 996 bp, Artificial Sequence
  Synthetic Construct
gacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaaggacaaaacccatacctacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatggcgtgcccagcagattttccggcagcggcttccacaccagcttcaacctgaccatcagcgatctgcaggccgacgacattgccacctactattgtcaggtgctgcagttcttcggcagaggcagcagactgcacatcaaggataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 366 - protein, 447 aa, Artificial Sequence; identical to SEQ ID NO: 350
  Synthetic Construct

SEQ ID NO: 367 - protein, 214 aa, Artificial Sequence; identical to SEQ ID NO: 351
  Synthetic Construct

SEQ ID NO: 368 - protein, 573 aa, Artificial Sequence
  Synthetic Construct
QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSARTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLGK

SEQ ID NO: 369 - protein, 334 aa, Artificial Sequence
  Synthetic Construct
YIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKGQPKAAPDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKTKGPSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 370 - DNA, 1341 bp, Artificial Sequence; identical to SEQ ID NO: 354
  Synthetic Construct

SEQ ID NO: 371 - DNA, 642 bp, Artificial Sequence; identical to SEQ ID NO: 355
  Synthetic Construct

SEQ ID NO: 372 - DNA, 1719 bp, Artificial Sequence
  Synthetic Construct
caggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtagcagagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgcccggaccgccagcacaaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggcaag

SEQ ID NO: 373 - DNA, 1002 bp, Artificial Sequence
  Synthetic Construct
tacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatggcgtgcccagcagattttccggcagcggcttccacaccagcttcaacctgaccatcagcgatctgcaggccgacgacattgccacctactattgtcaggtgctgcagttcttcggcagaggcagcagactgcacatcaagggccagcccaaggccgcccccgacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaagaccaagggccccagccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 374 - protein, 447 aa, Artificial Sequence; identical to SEQ ID NO: 350
  Synthetic Construct

SEQ ID NO: 375 - protein, 214 aa, Artificial Sequence; identical to SEQ ID NO: 351
  Synthetic Construct

SEQ ID NO: 376 - protein, 580 aa, Artificial Sequence
  Synthetic Construct
QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSADKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLGK

SEQ ID NO: 377 - protein, 332 aa, Artificial Sequence
  Synthetic Construct
YIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKDKTHTDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 378 - DNA, 1341 bp, Artificial Sequence; identical to SEQ ID NO: 354
  Synthetic Construct

SEQ ID NO: 379 - DNA, 642 bp, Artificial Sequence; identical to SEQ ID NO: 355
  Synthetic Construct

SEQ ID NO: 380 - DNA, 1740 bp, Artificial Sequence
  Synthetic Construct
caggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtgacaaaacccataccagagcccacctggtgcagtctggcaccgccatgaagaaaccaggcgcctctgtgcgggtgtcctgtcagacaagcggctacaccttcaccgcccacatcctgttctggttccggcaggcccctggcagaggactggaatgggtgggatggatcaagccccagtatggcgccgtgaacttcggcggaggcttccgggatagagtgaccctgacccgggacgtgtaccgcgagatcgcctacatggacatccggggcctgaagcccgatgacaccgccgtgtactactgcgccagagacagaagctacggcgacagcagctgggctctggatgcttggggccagggcacaaccgtggtggtgtctgccgataagacccacaccgccagcacaaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggcaag

SEQ ID NO: 381 - DNA, 996 bp, Artificial Sequence
  Synthetic Construct
tacatccacgtgacccagagccccagcagcctgtccgtgtccatcggcgacagagtgaccatcaactgccagacctctcagggcgtgggcagcgacctgcactggtatcagcacaagcctggcagagcccccaagctgctgatccaccacacaagcagcgtggaagatggcgtgcccagcagattttccggcagcggcttccacaccagcttcaacctgaccatcagcgatctgcaggccgacgacattgccacctactattgtcaggtgctgcagttcttcggcagaggcagcagactgcacatcaaggacaaaacccataccgacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaaggataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 382 - protein, 447 aa, Artificial Sequence
  Synthetic Construct
QVQLQESGPGLVKPSQTLSLTCTVSGFSLSDYGVHWVRQPPGKGLEWLGVIWAGGGTNYNPSLKSRKTISKDTSKNQVSLKLSSVTAADTAVYYCARDKGYSYYYSMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPCQEEMTKNQVSLWCLVKGFYPSDIAVEWESNGQPENNYKTTPPVLDSDGSFFLYSKLTVDKSRWQEGNVFSCSVMHEALHNHYTQKSLSLSLGK

SEQ ID NO: 383 - protein, 218 aa, Artificial Sequence
  Synthetic Construct
DIVLTQSPASLAVSPGQRATITCRASESVEYYVTSLMQWYQQKPGQPPKLLIFAASNVESGVPARFSGSGSGTDFTLTINPVEANDVANYYCQQSRKVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 384 - protein, 573 aa, Artificial Sequence; identical to SEQ ID NO: 352
  Synthetic Construct

SEQ ID NO: 385 - protein, 334 aa, Artificial Sequence; identical to SEQ ID NO: 353
  Synthetic Construct

SEQ ID NO: 386 - DNA, 1341 bp, Artificial Sequence
  Synthetic Construct
caggtgcagctgcaggaatctggccctggcctcgtgaagcctagccagaccctgagcctgacctgtaccgtgtccggcttcagcctgagcgactacggcgtgcactgggtgcgccagccacctggaaaaggcctggaatggctgggcgtgatctgggctggcggaggcaccaactacaaccccagcctgaagtccagaaagaccatcagcaaggacaccagcaagaaccaggtgtccctgaagctgagcagcgtgacagccgccgataccgccgtgtactactgcgccagagacaagggctacagctactactacagcatggactactggggccagggcaccaccgtgaccgtgtcatccgcgtcgaccaagggcccctcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtataccctgcccccttgccaggaagagatgaccaagaaccaggtgtccctgtggtgtctcgtgaaaggcttctaccccagcgacattgccgtggaatgggagagcaacggccagcccgagaacaactacaagaccaccccccctgtgctggacagcgacggctcattcttcctgtactccaagctgaccgtggacaagagccggtggcaggaaggcaacgtgttcagctgctccgtgatgcacgaggccctgcacaaccactacacccagaagtccctgtctctgtccctgggcaag

SEQ ID NO: 387 - DNA, 654 bp, Artificial Sequence
  Synthetic Construct
gacatcgtgctgacacagagccctgctagcctggccgtgtctcctggacagagggccaccatcacctgtagagccagcgagagcgtggaatattacgtgaccagcctgatgcagtggtatcagcagaagcccggccagccccccaagctgctgattttcgccgccagcaacgtggaaagcggcgtgccagccagattttccggcagcggctctggcaccgacttcaccctgaccatcaaccccgtggaagccaacgacgtggccaactactactgccagcagagccggaaggtgccctacacctttggccagggcaccaagctggaaatcaagcgtacggtggccgctcccagcgtgttcatcttcccacctagcgacgagcagctgaagtccggcacagcctctgtcgtgtgcctgctgaacaacttctacccccgcgaggccaaggtgcagtggaaggtggacaatgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtctagccccgtgaccaagagcttcaaccggggcgagtgt

SEQ ID NO: 388 - DNA, 1719 bp, Artificial Sequence; identical to SEQ ID NO: 356
  Synthetic Construct

SEQ ID NO: 389 - DNA, 1002 bp, Artificial Sequence; identical to SEQ ID NO: 357
  Synthetic Construct

SEQ ID NO: 390 - protein, 447 aa, Artificial Sequence; identical to SEQ ID NO: 382
  Synthetic Construct

SEQ ID NO: 391 - protein, 218 aa, Artificial Sequence; identical to SEQ ID NO: 383
  Synthetic Construct

SEQ ID NO: 392 - protein, 580 aa, Artificial Sequence; identical to SEQ ID NO: 360
  Synthetic Construct

SEQ ID NO: 393 - protein, 332 aa, Artificial Sequence; identical to SEQ ID NO: 361
  Synthetic Construct

SEQ ID NO: 394 - DNA, 1341 bp, Artificial Sequence; identical to SEQ ID NO: 386
  Synthetic Construct

SEQ ID NO: 395 - DNA, 654 bp, Artificial Sequence; identical to SEQ ID NO: 387
  Synthetic Construct

SEQ ID NO: 396 - DNA, 1740 bp, Artificial Sequence; identical to SEQ ID NO: 364
  Synthetic Construct

SEQ ID NO: 397 - DNA, 996 bp, Artificial Sequence; identical to SEQ ID NO: 365
  Synthetic Construct

SEQ ID NO: 398 - protein, 447 aa, Artificial Sequence; identical to SEQ ID NO: 382
  Synthetic Construct

SEQ ID NO: 399 - protein, 218 aa, Artificial Sequence; identical to SEQ ID NO: 383
  Synthetic Construct

SEQ ID NO: 400 - protein, 573 aa, Artificial Sequence; identical to SEQ ID NO: 368
  Synthetic Construct

SEQ ID NO: 401 - protein, 334 aa, Artificial Sequence; identical to SEQ ID NO: 369
  Synthetic Construct

SEQ ID NO: 402 - DNA, 1341 bp, Artificial Sequence; identical to SEQ ID NO: 386
  Synthetic Construct

SEQ ID NO: 403 - DNA, 654 bp, Artificial Sequence; identical to SEQ ID NO: 387
  Synthetic Construct

SEQ ID NO: 404 - DNA, 1719 bp, Artificial Sequence; identical to SEQ ID NO: 372
  Synthetic Construct

SEQ ID NO: 405 - DNA, 1002 bp, Artificial Sequence; identical to SEQ ID NO: 373
  Synthetic Construct

SEQ ID NO: 406 - protein, 447 aa, Artificial Sequence; identical to SEQ ID NO: 382
  Synthetic Construct

SEQ ID NO: 407 - protein, 218 aa, Artificial Sequence; identical to SEQ ID NO: 383
  Synthetic Construct

SEQ ID NO: 408 - protein, 580 aa, Artificial Sequence; identical to SEQ ID NO: 376
  Synthetic Construct

SEQ ID NO: 409 - protein, 332 aa, Artificial Sequence; identical to SEQ ID NO: 377
  Synthetic Construct

SEQ ID NO: 410 - DNA, 1341 bp, Artificial Sequence; identical to SEQ ID NO: 386
  Synthetic Construct

SEQ ID NO: 411 - DNA, 654 bp, Artificial Sequence; identical to SEQ ID NO: 387
  Synthetic Construct

SEQ ID NO: 412 - DNA, 1740 bp, Artificial Sequence; identical to SEQ ID NO: 380
  Synthetic Construct

SEQ ID NO: 413 - DNA, 996 bp, Artificial Sequence; identical to SEQ ID NO: 381
  Synthetic Construct

SEQ ID NO: 414 - protein, 447 aa, Artificial Sequence; identical to SEQ ID NO: 350
  Synthetic Construct

SEQ ID NO: 415 - protein, 214 aa, Artificial Sequence; identical to SEQ ID NO: 351
  Synthetic Construct

SEQ ID NO: 416 - protein, 592 aa, Artificial Sequence
  Synthetic Construct
QVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSSQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSRTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLGK

SEQ ID NO: 417 - protein, 343 aa, Artificial Sequence
  Synthetic Construct
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKGQPKAAPDFVLTQSPHSLSVTPGESASISCKSSHSLIHGDRNNYLAWYVQKPGRSPQLLIYLASSRASGVPDRFSGSGSDKDFTLKISRVETEDVGTYYCMQGRESPWTFGQGTKVDIKTKGPSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 418 - DNA, 1341 bp, Artificial Sequence; identical to SEQ ID NO: 354
  Synthetic Construct

SEQ ID NO: 419 - DNA, 642 bp, Artificial Sequence; identical to SEQ ID NO: 355
  Synthetic Construct

SEQ ID NO: 420 - DNA, 1776 bp, Artificial Sequence
  Synthetic Construct
caggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatcttctcaggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtcggaccgcttcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggcaag

SEQ ID NO: 421 - DNA, 1029 bp, Artificial Sequence
  Synthetic Construct
gacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaagggccagcccaaggccgcccccgacttcgtgctgacccagagccctcacagcctgagcgtgacacctggcgagagcgccagcatcagctgcaagagcagccactccctgatccacggcgaccggaacaactacctggcttggtacgtgcagaagcccggcagatccccccagctgctgatctacctggccagcagcagagccagcggcgtgcccgatagattttctggcagcggcagcgacaaggacttcaccctgaagatcagccgggtggaaaccgaggacgtgggcacctactactgtatgcagggcagagagagcccctggacctttggccagggcaccaaggtggacatcaagaccaagggccccagccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 422 - protein, 447 aa, Artificial Sequence; identical to SEQ ID NO: 350
  Synthetic Construct

SEQ ID NO: 423 - protein, 214 aa, Artificial Sequence; identical to SEQ ID NO: 351
  Synthetic Construct

SEQ ID NO: 424 - protein, 599 aa, Artificial Sequence
  Synthetic Construct
QVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSDKTHTQVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLGK

SEQ ID NO: 425 - protein, 341 aa, Artificial Sequence
  Synthetic Construct
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKDKTHTDFVLTQSPHSLSVTPGESASISCKSSHSLIHGDRNNYLAWYVQKPGRSPQLLIYLASSRASGVPDRFSGSGSDKDFTLKISRVETEDVGTYYCMQGRESPWTFGQGTKVDIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 426 - DNA, 1341 bp, Artificial Sequence; identical to SEQ ID NO: 354
  Synthetic Construct

SEQ ID NO: 427 - DNA, 642 bp, Artificial Sequence; identical to SEQ ID NO: 355
  Synthetic Construct

SEQ ID NO: 428 - DNA, 1797 bp, Artificial Sequence
  Synthetic Construct
caggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctgacaaaacccatacccaggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtgataagacccacaccgcttcgaccaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggcaag

SEQ ID NO: 429 - DNA, 1023 bp, Artificial Sequence
  Synthetic Construct
gacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaaggacaaaacccataccgacttcgtgctgacccagagccctcacagcctgagcgtgacacctggcgagagcgccagcatcagctgcaagagcagccactccctgatccacggcgaccggaacaactacctggcttggtacgtgcagaagcccggcagatccccccagctgctgatctacctggccagcagcagagccagcggcgtgcccgatagattttctggcagcggcagcgacaaggacttcaccctgaagatcagccgggtggaaaccgaggacgtgggcacctactactgtatgcagggcagagagagcccctggacctttggccagggcaccaaggtggacatcaaggataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 430 - protein, 447 aa, Artificial Sequence; identical to SEQ ID NO: 350
  Synthetic Construct

SEQ ID NO: 431 - protein, 214 aa, Artificial Sequence; identical to SEQ ID NO: 351
  Synthetic Construct

SEQ ID NO: 432 - protein, 592 aa, Artificial Sequence
  Synthetic Construct
QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSSQVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSRTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLGK

SEQ ID NO: 433 - protein, 343 aa, Artificial Sequence
  Synthetic Construct
DFVLTQSPHSLSVTPGESASISCKSSHSLIHGDRNNYLAWYVQKPGRSPQLLIYLASSRASGVPDRFSGSGSDKDFTLKISRVETEDVGTYYCMQGRESPWTFGQGTKVDIKGQPKAAPDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKTKGPSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 434 - DNA, 1341 bp, Artificial Sequence; identical to SEQ ID NO: 354
  Synthetic Construct

SEQ ID NO: 435 - DNA, 642 bp, Artificial Sequence; identical to SEQ ID NO: 355
  Synthetic Construct

SEQ ID NO: 436 - DNA, 1776 bp, Artificial Sequence
  Synthetic Construct
caggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtagccaggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctcggaccgccagcacaaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggcaag

SEQ ID NO: 437 - DNA, 1029 bp, Artificial Sequence
  Synthetic Construct
gacttcgtgctgacccagagccctcacagcctgagcgtgacacctggcgagagcgccagcatcagctgcaagagcagccactccctgatccacggcgaccggaacaactacctggcttggtacgtgcagaagcccggcagatccccccagctgctgatctacctggccagcagcagagccagcggcgtgcccgatagattttctggcagcggcagcgacaaggacttcaccctgaagatcagccgggtggaaaccgaggacgtgggcacctactactgtatgcagggcagagagagcccctggacctttggccagggcaccaaggtggacatcaagggccagcccaaggccgcccccgacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaagaccaagggccccagccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 438 - protein, 447 aa, Artificial Sequence; identical to SEQ ID NO: 350
  Synthetic Construct

SEQ ID NO: 439 - protein, 214 aa, Artificial Sequence; identical to SEQ ID NO: 351
  Synthetic Construct

SEQ ID NO: 440 - protein, 599 aa, Artificial Sequence
  Synthetic Construct
QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSSDKTHTQVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSDKTHTASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVCTLPPSQEEMTKNQVSLSCAVKGFYPSDIAVEWESNGQPENNYKTTPPVLDSDGSFFLVSKLTVDKSRWQEGNVFSCSVMHEALHNHYTQKSLSLSLGK

SEQ ID NO: 441 - protein, 341 aa, Artificial Sequence
  Synthetic Construct
DFVLTQSPHSLSVTPGESASISCKSSHSLIHGDRNNYLAWYVQKPGRSPQLLIYLASSRASGVPDRFSGSGSDKDFTLKISRVETEDVGTYYCMQGRESPWTFGQGTKVDIKDKTHTDIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIKDKTHTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 442 - DNA, 1341 bp, Artificial Sequence; identical to SEQ ID NO: 354
  Synthetic Construct

SEQ ID NO: 443 - DNA, 642 bp, Artificial Sequence; identical to SEQ ID NO: 355
  Synthetic Construct

SEQ ID NO: 444 - DNA, 1797 bp, Artificial Sequence
  Synthetic Construct
caggtgcagctggtggaatctggcggcggagtggtgcagcctggcagaagcctgagactgagctgtgccgccagcggcttcaccttcaccaaggcctggatgcactgggtgcgccaggcccctggaaagcagctggaatgggtggcccagatcaaggacaagagcaacagctacgccacctactacgccgacagcgtgaagggccggttcaccatcagccgggacgacagcaagaacaccctgtacctgcagatgaacagcctgcgggccgaggacaccgccgtgtactactgtcggggcgtgtactatgccctgagccccttcgattactggggccagggaaccctcgtgaccgtgtctagtgacaaaacccatacccaggtgcacctgacacagagcggacccgaagtgcggaagcctggcacctctgtgaaggtgtcctgcaaggcccctggcaacaccctgaaaacctacgacctgcactgggtgcgcagcgtgccaggacagggactgcagtggatgggctggatcagccacgagggcgacaagaaagtgatcgtggaacggttcaaggccaaagtgaccatcgactgggacagaagcaccaacaccgcctacctgcagctgagcggcctgacctctggcgataccgccgtgtactactgcgccaagggcagcaagcaccggctgagagactacgccctgtacgacgatgacggcgccctgaactgggccgtggatgtggactacctgagcaacctggaattctggggccagggcacagccgtgaccgtgtcatctgataagacccacaccgccagcacaaagggcccatcggtgttccctctggccccttgcagcagaagcaccagcgaatctacagccgccctgggctgcctcgtgaaggactactttcccgagcccgtgaccgtgtcctggaactctggcgctctgacaagcggcgtgcacacctttccagccgtgctccagagcagcggcctgtactctctgagcagcgtcgtgacagtgcccagcagcagcctgggcaccaagacctacacctgtaacgtggaccacaagcccagcaacaccaaggtggacaagcgggtggaatctaagtacggccctccctgccctccttgcccagcccctgaatttctgggcggaccctccgtgttcctgttccccccaaagcccaaggacaccctgatgatcagccggacccccgaagtgacctgcgtggtggtggatgtgtcccaggaagatcccgaggtgcagttcaattggtacgtggacggcgtggaagtgcacaacgccaagaccaagcccagagaggaacagttcaacagcacctaccgggtggtgtccgtgctgaccgtgctgcaccaggactggctgaacggcaaagagtacaagtgcaaggtgtccaacaagggcctgcccagctccatcgagaaaaccatcagcaaggccaagggccagccccgcgagcctcaagtgtgtaccctgccccctagccaggaagagatgaccaagaaccaggtgtccctgagctgtgccgtgaaaggcttctaccccagcgacattgccgtggaatgggagagcaacggccagcccgagaacaactacaagaccaccccccctgtgctggacagcgacggctcattcttcctggtgtccaagctgaccgtggacaagagccggtggcaggaaggcaacgtgttcagctgctccgtgatgcacgaggccctgcacaaccactacacccagaagtccctgtctctgtccctgggcaag

SEQ ID NO: 445 - DNA, 1023 bp, Artificial Sequence
  Synthetic Construct
gacttcgtgctgacccagagccctcacagcctgagcgtgacacctggcgagagcgccagcatcagctgcaagagcagccactccctgatccacggcgaccggaacaactacctggcttggtacgtgcagaagcccggcagatccccccagctgctgatctacctggccagcagcagagccagcggcgtgcccgatagattttctggcagcggcagcgacaaggacttcaccctgaagatcagccgggtggaaaccgaggacgtgggcacctactactgtatgcagggcagagagagcccctggacctttggccagggcaccaaggtggacatcaaggacaaaacccataccgacatcgtgatgacccagacccccctgagcctgagcgtgacacctggacagcctgccagcatcagctgcaagagcagccagagcctggtgcacaacaacgccaacacctacctgagctggtatctgcagaagcccggccagagcccccagtccctgatctacaaggtgtccaacagattcagcggcgtgcccgacagattctccggcagcggctctggcaccgacttcaccctgaagatcagccgggtggaagccgaggacgtgggcgtgtactattgtggccagggcacccagtaccccttcacctttggcagcggcaccaaggtggaaatcaaggataagacccatacccgtacggtggccgctcccagcgtgttcatcttcccacctagcgacgagcagctgaagtccggcacagcctctgtcgtgtgcctgctgaacaacttctacccccgcgaggccaaagtgcagtggaaggtggacaacgccctgcagagcggcaacagccaggaaagcgtgaccgagcaggacagcaaggactccacctacagcctgagcagcaccctgacactgagcaaggccgactacgagaagcacaaggtgtacgcctgcgaagtgacccaccagggcctgtctagccccgtgaccaagagcttcaaccggggcgagtgt

SEQ ID NO: 446 - protein, 447 aa, Artificial Sequence; identical to SEQ ID NO: 382
  Synthetic Construct

SEQ ID NO: 447 - protein, 218 aa, Artificial Sequence; identical to SEQ ID NO: 383
  Synthetic Construct

SEQ ID NO: 448 - protein, 592 aa, Artificial Sequence; identical to SEQ ID NO: 416
  Synthetic Construct

SEQ ID NO: 449 - protein, 343 aa, Artificial Sequence; identical to SEQ ID NO: 417
  Synthetic Construct

SEQ ID NO: 450 - DNA, 1341 bp, Artificial Sequence; identical to SEQ ID NO: 386
  Synthetic Construct

SEQ ID NO: 451 - DNA, 654 bp, Artificial Sequence; identical to SEQ ID NO: 387
  Synthetic Construct

SEQ ID NO: 452 - DNA, 1776 bp, Artificial Sequence; identical to SEQ ID NO: 420
  Synthetic Construct

SEQ ID NO: 453 - DNA, 1029 bp, Artificial Sequence; identical to SEQ ID NO: 421
  Synthetic Construct

SEQ ID NO: 454 - protein, 447 aa, Artificial Sequence; identical to SEQ ID NO: 382
  Synthetic Construct

SEQ ID NO: 455 - protein, 218 aa, Artificial Sequence; identical to SEQ ID NO: 383
  Synthetic Construct

SEQ ID NO: 456 - protein, 599 aa, Artificial Sequence; identical to SEQ ID NO: 424
  Synthetic Construct

SEQ ID NO: 457 - protein, 341 aa, Artificial Sequence; identical to SEQ ID NO: 425
  Synthetic Construct

SEQ ID NO: 458 - DNA, 1341 bp, Artificial Sequence; identical to SEQ ID NO: 386
  Synthetic Construct

SEQ ID NO: 459 - DNA, 654 bp, Artificial Sequence; identical to SEQ ID NO: 387
  Synthetic Construct

SEQ ID NO: 460 - DNA, 1797 bp, Artificial Sequence; identical to SEQ ID NO: 428
  Synthetic Construct

SEQ ID NO: 461 - DNA, 1023 bp, Artificial Sequence; identical to SEQ ID NO: 429
  Synthetic Construct

SEQ ID NO: 462 - protein, 447 aa, Artificial Sequence; identical to SEQ ID NO: 382
  Synthetic Construct

SEQ ID NO: 463 - protein, 218 aa, Artificial Sequence; identical to SEQ ID NO: 383
  Synthetic Construct

SEQ ID NO: 464 - protein, 592 aa, Artificial Sequence; identical to SEQ ID NO: 432
  Synthetic Construct

SEQ ID NO: 465 - protein, 343 aa, Artificial Sequence; identical to SEQ ID NO: 433
  Synthetic Construct

SEQ ID NO: 466 - DNA, 1341 bp, Artificial Sequence; identical to SEQ ID NO: 386
  Synthetic Construct

SEQ ID NO: 467 - DNA, 654 bp, Artificial Sequence; identical to SEQ ID NO: 387
  Synthetic Construct

SEQ ID NO: 468 - DNA, 1776 bp, Artificial Sequence; identical to SEQ ID NO: 436
  Synthetic Construct

SEQ ID NO: 469 - DNA, 1029 bp, Artificial Sequence; identical to SEQ ID NO: 437
  Synthetic Construct

SEQ ID NO: 470 - protein, 447 aa, Artificial Sequence; identical to SEQ ID NO: 382
  Synthetic Construct

SEQ ID NO: 471 - protein, 218 aa, Artificial Sequence; identical to SEQ ID NO: 383
  Synthetic Construct

SEQ ID NO: 472 - protein, 599 aa, Artificial Sequence; identical to SEQ ID NO: 440
  Synthetic Construct

SEQ ID NO: 473 - protein, 341 aa, Artificial Sequence; identical to SEQ ID NO: 441
  Synthetic Construct

SEQ ID NO: 474 - DNA, 1341 bp, Artificial Sequence; identical to SEQ ID NO: 386
  Synthetic Construct

SEQ ID NO: 475 - DNA, 654 bp, Artificial Sequence; identical to SEQ ID NO: 387
  Synthetic Construct

SEQ ID NO: 476 - DNA, 1797 bp, Artificial Sequence; identical to SEQ ID NO: 444
  Synthetic Construct

SEQ ID NO: 477 - DNA, 1023 bp, Artificial Sequence; identical to SEQ ID NO: 445
  Synthetic Construct

SEQ ID NO: 478 - skipped

SEQ ID NO: 479 - protein, 8 aa, Artificial Sequence
  Synthetic Construct
GYTFTSYY

SEQ ID NO: 480 - protein, 8 aa, Artificial Sequence
  Synthetic Construct
IYPGNVNT

SEQ ID NO: 481 - protein, 13 aa, Artificial Sequence
  Synthetic Construct
TRSHYGLDWNFDV

SEQ ID NO: 482 - protein, 8 aa, Artificial Sequence
  Synthetic Construct
GFSLSDYG

SEQ ID NO: 483 - protein, 7 aa, Artificial Sequence
  Synthetic Construct
IWAGGGT

SEQ ID NO: 484 - protein, 13 aa, Artificial Sequence
  Synthetic Construct
ARDKGYSYYYSMD

SEQ ID NO: 485 - protein, 8 aa, Artificial Sequence
  Synthetic Construct
GFTFTKAW

SEQ ID NO: 486 - protein, 7 aa, Artificial Sequence
  Synthetic Construct
IKDKSNS

SEQ ID NO: 487 - protein, 12 aa, Artificial Sequence
  Synthetic Construct
RGVYYALSPFDY

SEQ ID NO: 488 - protein, 6 aa, Artificial Sequence
  Synthetic Construct
QNIYVW

SEQ ID NO: 489 - protein, 3 aa, Artificial Sequence
  Synthetic Construct
KAS

SEQ ID NO: 490 - protein, 9 aa, Artificial Sequence
  Synthetic Construct
QQGQTYPYT

SEQ ID NO: 491 - protein, 10 aa, Artificial Sequence
  Synthetic Construct
ESVEYYVTSL

SEQ ID NO: 492 - protein, 3 aa, Artificial Sequence
  Synthetic Construct
AAS

SEQ ID NO: 493 - protein, 9 aa, Artificial Sequence
  Synthetic Construct
QQSRKVPYT

SEQ ID NO: 494 - protein, 11 aa, Artificial Sequence
  Synthetic Construct
QSLVHNNANTY

SEQ ID NO: 495 - protein, 3 aa, Artificial Sequence
  Synthetic Construct
KVS

SEQ ID NO: 496 - protein, 7 aa, Artificial Sequence
  Synthetic Construct
GQGTQYP

SEQ ID NO: 497 - protein, 15 aa, Artificial Sequence
  Synthetic Construct
LKPRGGAVNYARPLQ

SEQ ID NO: 498 - protein, 20 aa, Artificial Sequence
  Synthetic Construct
TGKYYDFWWGYPPGEEYFQD

SEQ ID NO: 499 - protein, 8 aa, Artificial Sequence
  Synthetic Construct
GASISDSY

SEQ ID NO: 500 - protein, 6 aa, Artificial Sequence
  Synthetic Construct
SLRSHY

SEQ ID NO: 501 - protein, 3 aa, Artificial Sequence
  Synthetic Construct
GKN

SEQ ID NO: 502 - protein, 121 aa, Artificial Sequence
  Synthetic Construct
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSS

SEQ ID NO: 503 - protein, 122 aa, Artificial Sequence [sequence omitted]

SEQ ID NO: 504 - protein, 131 aa, Artificial Sequence
  Synthetic Construct
EVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWSGYPPGEEYFQDWGQGTLVIVSS

SEQ ID NO: 505 - protein, 131 aa, Artificial Sequence
  Synthetic Construct
EVRLVESGGGLVKPGGSLRLSCSASGFDFDNAWMTWVRQPPGKGLEWVGRITGPGEGWSVDYAESVKGRFTISRDNTKNTLYLEMNNVRTEDTGYYFCARTGKYYDFWWGYPPGEEYFQDWGQGTLVIVSS

SEQ ID NO: 506 - protein, 141 aa, Artificial Sequence
  Synthetic Construct
QVHLTQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSS

SEQ ID NO: 507 - protein, 145 aa, Artificial Sequence
  Synthetic Construct
QVQLVESGGGVVQPGTSLRLSCAASQFRFDGYGMHWVRQAPGKGLEWVASISHDGIKKYHAEKVWGRFTISRDNSKNTLYLQMNSLRPEDTALYYCAKDLREDECEEWWSDYYDFGKQLPCAKSRGGLVGIADNWGQGTMVTVSS

SEQ ID NO: 508 - protein, 132 aa, Artificial Sequence
  Synthetic Construct
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSS

SEQ ID NO: 509 - protein, 120 aa, Artificial Sequence
  Synthetic Construct
QVQLVQSGAEVVKPGASVKVSCKASGYTFTSYYIHWVRQAPGQGLEWIGSIYPGNVNTNYAQKFQGRATLTVDTSISTAYMELSRLRSDDTAVYYCTRSHYGLDWNFDVWGKGTTVTVSS

SEQ ID NO: 510 - protein, 120 aa, Artificial Sequence
  Synthetic Construct
QVQLQESGPGLVKPSQTLSLTCTVSGFSLSDYGVHWVRQPPGKGLEWLGVIWAGGGTNYNPSLKSRKTISKDTSKNQVSLKLSSVTAADTAVYYCARDKGYSYYYSMDYWGQGTTVTVSS

SEQ ID NO: 511 - protein, 121 aa, Artificial Sequence
  Synthetic Construct
QVQLVESGGGVVQPGRSLRLSCAASGFTFTKAWMHWVRQAPGKQLEWVAQIKDKSNSYATYYADSVKGRFTISRDDSKNTLYLQMNSLRAEDTAVYYCRGVYYALSPFDYWGQGTLVTVSS

SEQ ID NO: 512 - protein, 103 aa, Artificial Sequence
  Synthetic Construct
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 513 - protein, 103 aa, Artificial Sequence [sequence omitted]

SEQ ID NO: 514 - protein, 103 aa, Artificial Sequence
  Synthetic Construct
YIHVTQSPSSLSVSIGDRVTINCQTSQGVGSDLHWYQHKPGRAPKLLIHHTSSVEDGVPSRFSGSGFHTSFQLTISDLQADDIATYYCQVLQFFGRGSRLHIK

SEQ ID NO: 515 - protein, 103 aa, Artificial Sequence
  Synthetic Construct
YIHVTQSPSSLSVSIGDRVTINCQTSQGVGSDLHWYQHKPGRAPKLLIHHTSSVEEGVPSRFSGSGFHTSFNLTISDLQADDIATYYCQVLQFFGRGSRLHIK

SEQ ID NO: 516 - protein, 103 aa, Artificial Sequence
  Synthetic Construct
YIHVTQSPSSLSVSIGDRVTINCQTSQGVGSDLHWYQHKPGRAPKLLIHHTSSVEDAVPSRFSGSGFHTSFNLTISDLQADDIATYYCQVLQFFGRGSRLHIK

SEQ ID NO: 517 - protein, 103 aa, Artificial Sequence
  Synthetic Construct
YIHVTQSPSSLSVSIGDRVTINCQTSQGVGSDLHWYQHKPGRAPKLLIHHTSSVEEGVPSRFSGSGFHTSFQLTISDLQADDIATYYCQVLQFFGRGSRLHIK

SEQ ID NO: 518 - protein, 109 aa, Artificial Sequence
  Synthetic Construct
ASELTQDPAVSVALKQTVTITCRGDSLRSHYASWYQKKPGQAPVLLFYGKNNRPSGIPDRFSGSASGNRASLTITGAQAEDEADYYCSSRDKSGSRLSVFGGGTKLTVL

SEQ ID NO: 519 - protein, 112 aa, Artificial Sequence
  Synthetic Construct
DFVLTQSPHSLSVTPGESASISCKSSHSLIHGDRNNYLAWYVQKPGRSPQLLIYLASSRASGVPDRFSGSGSDKDFTLKISRVETEDVGTYYCMQGRESPWTFGQGTKVDIK

SEQ ID NO: 520 - protein, 111 aa, Artificial Sequence
  Synthetic Construct
QSVLTQPPSVSAAPGQKVTISCSGNTSNIGNNFVSWYQQRPGRAPQLLIYETDKRPSGIPDRFSASKSGTSGTLAITGLQTGDEADYYCATWAASLSSARVFGTGTKVIVL

SEQ ID NO: 521 - protein, 105 aa, Artificial Sequence
  Synthetic Construct
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVL

SEQ ID NO: 522 - protein, 107 aa, Artificial Sequence
  Synthetic Construct
DIQMTQSPSSLSASVGDRVTITCQASQNIYVWLNWYQQKPGKAPKLLIYKASNLHTGVPSRFSGSGSGTDFTLTISSLQPEDIATYYCQQGQTYPYTFGQGTKLEIK

SEQ ID NO: 523 - protein, 111 aa, Artificial Sequence
  Synthetic Construct
DIVLTQSPASLAVSPGQRATITCRASESVEYYVTSLMQWYQQKPGQPPKLLIFAASNVESGVPARFSGSGSGTDFTLTINPVEANDVANYYCQQSRKVPYTFGQGTKLEIK

SEQ ID NO: 524 - protein, 112 aa, Artificial Sequence
  Synthetic Construct
DIVMTQTPLSLSVTPGQPASISCKSSQSLVHNNANTYLSWYLQKPGQSPQSLIYKVSNRFSGVPDRFSGSGSGTDFTLKISRVEAEDVGVYYCGQGTQYPFTFGSGTKVEIK

SEQ ID NO: 525 - protein, 5 aa, Artificial Sequence
  Synthetic Construct
DKTHT

SEQ ID NO: 526 - protein, 6 aa, Artificial Sequence
  Synthetic Construct
TKGPSR

What is claimed is:

1. A bispecific binding protein that specifically binds to two different HIV-1 Env protein epitopes, wherein the bispecific binding protein comprises a first and a second binding site;
   wherein the first binding site comprises $V_{H1}$ and $V_{L1}$, wherein $V_{H1}$ is a first immunoglobulin heavy chain variable domain that comprises the amino acid sequence of SEQ ID NO:506, and wherein $V_{L1}$ is a first immunoglobulin light chain variable domain that comprises the amino acid sequence of SEQ ID NO:519; and
   wherein the second binding site comprises $V_{H2}$ and $V_{L2}$, wherein $V_{H2}$ is a second immunoglobulin heavy chain variable domain that comprises the amino acid sequence of SEQ ID NO:504, and wherein $V_{L2}$ is a second immunoglobulin light chain variable domain that comprises the amino acid sequence of SEQ ID NO:518.

2. A bispecific binding protein that specifically binds to two different HIV-1 Env protein epitopes, wherein the bispecific binding protein comprises a first and a second binding site;
   wherein the first binding site comprises $V_{H1}$ and $V_{L1}$, wherein $V_{H1}$ is a first immunoglobulin heavy chain variable domain that comprises the amino acid sequence of SEQ ID NO:503, and wherein $V_{L1}$ is a first immunoglobulin light chain variable domain that comprises the amino acid sequence of SEQ ID NO:513; and
   wherein the second binding site comprises $V_{H2}$ and $V_{L2}$, wherein $V_{H2}$ is a second immunoglobulin heavy chain variable domain that comprises the amino acid sequence of SEQ ID NO:506, and wherein $V_{L2}$ is a second immunoglobulin light chain variable domain that comprises the amino acid sequence of SEQ ID NO:519.

3. A bispecific binding protein that specifically binds to two different HIV-1 Env protein epitopes, wherein the bispecific binding protein comprises a first and a second binding site;
  wherein the first binding site comprises $V_{H1}$ and $V_{L1}$, wherein $V_{H1}$ is a first immunoglobulin heavy chain variable domain that comprises the amino acid sequence of SEQ ID NO:506, and wherein $V_{L1}$ is a first immunoglobulin light chain variable domain that comprises the amino acid sequence of SEQ ID NO:519; and
  wherein the second binding site comprises $V_{H2}$ and $V_{L2}$, wherein $V_{H2}$ is a second immunoglobulin heavy chain variable domain that comprises the amino acid sequence of SEQ ID NO:503, and wherein $V_{L2}$ is a second immunoglobulin light chain variable domain that comprises the amino acid sequence of SEQ ID NO:513.

* * * * *